United States Patent 10,706,955 (BIOINFORMATIC PROCESSES FOR DETERMINATION OF PEPTIDE BINDING) - sequence listing, part 89

SEQ ID NO: 3384027 - protein, 38 aa, Plasmodium falciparum
IDIILMQNLLTLKNVLKFINKPLLRWGSANINRIPKYV

SEQ ID NO: 3384028 - protein, 32 aa, Plasmodium falciparum
IDIKKEYNLKYVKFKLSFLNEYSPDDIKFLSH

SEQ ID NO: 3384029 - protein, 30 aa, Plasmodium falciparum
IDILIEGVNIPWLYIGTLFSTFCWHTEDNY

SEQ ID NO: 3384030 - protein, 31 aa, Plasmodium falciparum
IDINKIHFDIIDYSFIFSKNLKKFVNYLKYV

SEQ ID NO: 3384031 - protein, 30 aa, Plasmodium falciparum
IDIPSDLFCFCNYFFFKEKYITFFKNVSND

SEQ ID NO: 3384032 - protein, 29 aa, Plasmodium falciparum
IDIQEIVKYLNSCLLILYNKENENENICL

SEQ ID NO: 3384033 - protein, 18 aa, Plasmodium falciparum
IDISLIADRAKKNIFPEM

SEQ ID NO: 3384034 - protein, 19 aa, Plasmodium falciparum
IDISLKMCRQLAEVINFLH

SEQ ID NO: 3384035 - protein, 26 aa, Plasmodium falciparum
IDISTFLWCCAYINIIYKPLFDSAYN

SEQ ID NO: 3384036 - protein, 26 aa, Plasmodium falciparum
IDKIAGRKILFIGKSIRILIRSNKWN

SEQ ID NO: 3384037 - protein, 33 aa, Plasmodium falciparum
IDKKKLGWWATNKYFPCYFYKFDNTNKYQNVPR

SEQ ID NO: 3384038 - protein, 28 aa, Plasmodium falciparum
IDKNVENFVFLDFIPVTEEYLKIKETLN

SEQ ID NO: 3384039 - protein, 17 aa, Plasmodium falciparum
IDKQIIIELIKNSNDIL

SEQ ID NO: 3384040 - protein, 33 aa, Plasmodium falciparum
IDKRSEIYYSNKAYDPQYLYNSNKLSSNIKITR

SEQ ID NO: 3384041 - protein, 23 aa, Plasmodium falciparum
IDKTHIWNILSVHALMLGNFEIA

SEQ ID NO: 3384042 - protein, 25 aa, Plasmodium falciparum
IDKYQKWKYIIRDDIIFDMNSLNIK

SEQ ID NO: 3384043 - protein, 27 aa, Plasmodium falciparum
IDLDDEILIANFPFNSLRDVENLTYTN

SEQ ID NO: 3384044 - protein, 26 aa, Plasmodium falciparum
IDLDYILLFYILYFNDNQNLYIPRVC

SEQ ID NO: 3384045 - protein, 30 aa, Plasmodium falciparum
IDLEYDEMLYKKYIQKLKINKINKYKEDNN

SEQ ID NO: 3384046 - protein, 18 aa, Plasmodium falciparum
IDLHKSVEKILLYATENR

SEQ ID NO: 3384047 - protein, 30 aa, Plasmodium falciparum
IDLRNELLRRFIYSLNSWMNMRRCIVACCE

SEQ ID NO: 3384048 - protein, 26 aa, Plasmodium falciparum
IDMSKVMYDIYFLCFHKNGCEYIIKK

SEQ ID NO: 3384049 - protein, 24 aa, Plasmodium falciparum
IDNFDNVILAYEPLWAIGTGKTAT

SEQ ID NO: 3384050 - protein, 51 aa, Plasmodium falciparum
IDNFNGPFDYLNYYFLCEIVFDDFSFKSPYHCYFFLRNQFENFKNVHTNYV

SEQ ID NO: 3384051 - protein, 24 aa, Plasmodium falciparum
IDNIHIYRYISKNEKMYLSKELEE

SEQ ID NO: 3384052 - protein, 41 aa, Plasmodium falciparum
IDNINYNLFYIIENIYRGFNKKIWKILKELIDFKYCDVYTY

SEQ ID NO: 3384053 - protein, 24 aa, Plasmodium falciparum
IDNIPYESIIFLFDDFNRKEKNII

SEQ ID NO: 3384054 - protein, 20 aa, Plasmodium falciparum
IDNKALFDTFSMFGNILSCK

SEQ ID NO: 3384055 - protein, 32 aa, Plasmodium falciparum
IDNKGKLYYIGFTIIHLNYLYELQKEGYVHLN

SEQ ID NO: 3384056 - protein, 32 aa, Plasmodium falciparum
IDNLINLRKILKFHHKLFFENHSKELRKISRC

SEQ ID NO: 3384057 - protein, 31 aa, Plasmodium falciparum
IDNLNKIREDPLTLIKKIELKKKKMMDEQKR

SEQ ID NO: 3384058 - protein, 18 aa, Plasmodium falciparum
IDNLSKANFISAGKICIC

SEQ ID NO: 3384059 - protein, 21 aa, Plasmodium falciparum
IDNVFPLSPYKDSLWKVFDTG

SEQ ID NO: 3384060 - protein, 29 aa, Plasmodium falciparum
IDNYKYWQYNTILLYNVIMIYTCEWPSLF

SEQ ID NO: 3384061 - protein, 17 aa, Plasmodium falciparum
IDNYLFIQIENITKHNL

SEQ ID NO: 3384062 - protein, 24 aa, Plasmodium falciparum
IDQLILLYQKVLPTLGDYLINEGS

SEQ ID NO: 3384063 - protein, 27 aa, Plasmodium falciparum
IDQLKEKINIIIIPNKGVINNFEEILS

SEQ ID NO: 3384064 - protein, 17 aa, Plasmodium falciparum
IDQTLQYIFSLMDSQKG

SEQ ID NO: 3384065 - protein, 18 aa, Plasmodium falciparum
IDRPLFKDFWDRYIKCIK

SEQ ID NO: 3384066 - protein, 27 aa, Plasmodium falciparum
IDSLDETAFSIIKLFNSKKKNDLSTKY

SEQ ID NO: 3384067 - protein, 29 aa, Plasmodium falciparum
IDSNILIIFELFKFGFLTTEALLPPDGKT

SEQ ID NO: 3384068 - protein, 30 aa, Plasmodium falciparum
IDSSKDYLKLKLPDSIFKHIRDLTSKDVKS

SEQ ID NO: 3384069 - protein, 17 aa, Plasmodium falciparum
IDTFNTVDLLRSSLAGE

SEQ ID NO: 3384070 - protein, 28 aa, Plasmodium falciparum
IDTVRRIDLLYIQLDTLVQSFAGVCTQV

SEQ ID NO: 3384071 - protein, 33 aa, Plasmodium falciparum
IDVGPFIEIQYWRYKHRYLLFIIEELRSKEIKS

SEQ ID NO: 3384072 - protein, 20 aa, Plasmodium falciparum
IDVKNILRLLKEPICLFGED

SEQ ID NO: 3384073 - protein, 18 aa, Plasmodium falciparum
IDVKQTFQYLFENKLITI

SEQ ID NO: 3384074 - protein, 18 aa, Plasmodium falciparum
IDVPLWRDKPQLPPYCRY

SEQ ID NO: 3384075 - protein, 19 aa, Plasmodium falciparum
IDYETILDCLTKEIDHYEK

SEQ ID NO: 3384076 - protein, 19 aa, Plasmodium falciparum
IDYKENVALIFSPSLNTEL

SEQ ID NO: 3384077 - protein, 17 aa, Plasmodium falciparum
IDYLLSKKKLQEATSIL

SEQ ID NO: 3384078 - protein, 40 aa, Plasmodium falciparum
IEALMCYNYISNAIIFEKGKFLRYIFMNNVNNIIVNEHMI

SEQ ID NO: 3384079 - protein, 20 aa, Plasmodium falciparum
IEALYNKKYKIFLMDNKQII

SEQ ID NO: 3384080 - protein, 28 aa, Plasmodium falciparum
IEAQNLIKYYLLSKKYKLILVNYFEWVN

SEQ ID NO: 3384081 - protein, 26 aa, Plasmodium falciparum
IECEKHMQLLISPGDMYMFKNQSHEM

SEQ ID NO: 3384082 - protein, 21 aa, Plasmodium falciparum
IECISNIILLEKYPQCSIKIK

SEQ ID NO: 3384083 - protein, 18 aa, Plasmodium falciparum
IECKATMLKILGNKIENF

SEQ ID NO: 3384084 - protein, 18 aa, Plasmodium falciparum
IECSKKILYSCLYIEENE

SEQ ID NO: 3384085 - protein, 26 aa, Plasmodium falciparum
IECVHDYIFLYFNKKALHKHDASNEM

SEQ ID NO: 3384086 - protein, 28 aa, Plasmodium falciparum
IEDIKLYCIEILKALNYLRKMSLTHTDL

SEQ ID NO: 3384087 - protein, 32 aa, Plasmodium falciparum
IEDINTKYIKLLLIPFILGNLCYETLNINIRY

SEQ ID NO: 3384088 - protein, 20 aa, Plasmodium falciparum
IEDKEFLLTTKKSLDIRIDD

SEQ ID NO: 3384089 - protein, 18 aa, Plasmodium falciparum
IEDNNLHILLTKVKKGES

SEQ ID NO: 3384090 - protein, 26 aa, Plasmodium falciparum
IEDRMKYLLILLNDTKKNNIKIERST

SEQ ID NO: 3384091 - protein, 20 aa, Plasmodium falciparum
IEDYFIFEKKLGMGGFGEVW

SEQ ID NO: 3384092 - protein, 19 aa, Plasmodium falciparum
IEEENKVLKIFKEEKNKIN

SEQ ID NO: 3384093 - protein, 26 aa, Plasmodium falciparum
IEEFGLKSLPYIKSSLSPGSKTVQKY

SEQ ID NO: 3384094 - protein, 28 aa, Plasmodium falciparum
IEEHAIIDITRQLLHALAYCHNLKDGPN

SEQ ID NO: 3384095 - protein, 41 aa, Plasmodium falciparum
IEEIEHIKKNHGYLHFMWLKRKTLCIEIIKCIATLTEKDTK

SEQ ID NO: 3384096 - protein, 23 aa, Plasmodium falciparum
IEEIEKIHFNIFDFIDMEKQTYE

SEQ ID NO: 3384097 - protein, 24 aa, Plasmodium falciparum
IEEKEKYVNSIKLKYDNAQKELLD

SEQ ID NO: 3384098 - protein, 33 aa, Plasmodium falciparum
IEEKKKYKKLLIYYLLYNNYLKLSASNIFENAS

SEQ ID NO: 3384099 - protein, 23 aa, Plasmodium falciparum
IEEKNPFLFFPNSQLNNTISNIQ

SEQ ID NO: 3384100 - protein, 25 aa, Plasmodium falciparum
IEEKYNICMLFYKYISNSTYLVHLL

SEQ ID NO: 3384101 - protein, 24 aa, Plasmodium falciparum
IEELIKNYRQKLYDEYYEKKKIQE

SEQ ID NO: 3384102 - protein, 19 aa, Plasmodium falciparum
IEELLKRMYGFKSGEDYIN

SEQ ID NO: 3384103 - protein, 18 aa, Plasmodium falciparum
IEELLWFIRGETNGNTLL

SEQ ID NO: 3384104 - protein, 31 aa, Plasmodium falciparum
IEENKPLKFCRSFHLFPLPSGGYFIFNDLFR

SEQ ID NO: 3384105 - protein, 57 aa, Plasmodium falciparum
IEESKKVFRLLKLLGEWIKYGLVLIFVNKQIEADLLYLELYKYDYNLLVLHGGQDQT

SEQ ID NO: 3384106 - protein, 26 aa, Plasmodium falciparum
IEETLSYIISILGEKHWLYASFNYII

SEQ ID NO: 3384107 - protein, 25 aa, Plasmodium falciparum
IEEVKNLCFIYPNKCNIILNFLSNN

SEQ ID NO: 3384108 - protein, 19 aa, Plasmodium falciparum
IEFFKPYKIMEKYIIFMRD

SEQ ID NO: 3384109 - protein, 18 aa, Plasmodium falciparum
IEFYINYYKKYNDKEVVE

SEQ ID NO: 3384110 - protein, 26 aa, Plasmodium falciparum
IEGHRYMLEKWKKEKWFIVLKENWKN

SEQ ID NO: 3384111 - protein, 28 aa, Plasmodium falciparum
IEGIIHIITTFWIDIFEKRIKNIEIIQN

SEQ ID NO: 3384112 - protein, 18 aa, Plasmodium falciparum
IEHIDYGDIFLTIHDTLK

SEQ ID NO: 3384113 - protein, 17 aa, Plasmodium falciparum
IEHKKMCFKKKYVCLEC

SEQ ID NO: 3384114 - protein, 19 aa, Plasmodium falciparum
IEHLKIWKPKKNYKFKDNN

SEQ ID NO: 3384115 - protein, 24 aa, Plasmodium falciparum
IEIAKKRILTILKILEDTLEEDKN

SEQ ID NO: 3384116 - protein, 23 aa, Plasmodium falciparum
IEIFLIYSYSSYKIFKPLIFLIY

SEQ ID NO: 3384117 - protein, 23 aa, Plasmodium falciparum
IEIKKKSLLKSKLKNDDIQTIIK

SEQ ID NO: 3384118 - protein, 18 aa, Plasmodium falciparum
IEIPDTLYYDILGVGVNA

SEQ ID NO: 3384119 - protein, 27 aa, Plasmodium falciparum
IEITIKTLPRIFLYKEMINKFQNGYSK

SEQ ID NO: 3384120 - protein, 24 aa, Plasmodium falciparum
IEKDGYIIFAFNIIPITINTNKNK

SEQ ID NO: 3384121 - protein, 30 aa, Plasmodium falciparum
IEKEKLFSLIDLLFKRAIPKSLTLIAKIRE

SEQ ID NO: 3384122 - protein, 28 aa, Plasmodium falciparum
IEKESLNLYLNKLFDKYCIIVHKIRTHR

SEQ ID NO: 3384123 - protein, 26 aa, Plasmodium falciparum
IEKEYKSFYLKFEYINQNTFCIHLKK

SEQ ID NO: 3384124 - protein, 26 aa, Plasmodium falciparum
IEKFNEPILFLWRNNRSIIIGKNQNI

SEQ ID NO: 3384125 - protein, 33 aa, Plasmodium falciparum
IEKGDEECCLILLKLLYVNIILNNYNYLYHILS

SEQ ID NO: 3384126 - protein, 23 aa, Plasmodium falciparum
IEKHFPNDLLSKCPYYINNKYIT

SEQ ID NO: 3384127 - protein, 17 aa, Plasmodium falciparum
IEKHIINYGICPVSGEV

SEQ ID NO: 3384128 - protein, 17 aa, Plasmodium falciparum
IEKIICSILLSRNIKKA

SEQ ID NO: 3384129 - protein, 25 aa, Plasmodium falciparum
IEKIRSIIAYKLWKYIVKDINLIKI

SEQ ID NO: 3384130 - protein, 29 aa, Plasmodium falciparum
IEKKELLELWAPKYLYFDALKYISMIKHA

SEQ ID NO: 3384131 - protein, 18 aa, Plasmodium falciparum
IEKKFIEQLYYLCGSQYT

SEQ ID NO: 3384132 - protein, 24 aa, Plasmodium falciparum
IEKKFINENIYINKQIIACNVKNE

SEQ ID NO: 3384133 - protein, 22 aa, Plasmodium falciparum
IEKKKRNIVIPRFKICEDSEEE

SEQ ID NO: 3384134 - protein, 42 aa, Plasmodium falciparum
IEKKLPMKPNMFLTLINDLKIEFILTFEKFAIGNIKIKKKYK

SEQ ID NO: 3384135 - protein, 17 aa, Plasmodium falciparum
IEKNTEILIEERNYINE

SEQ ID NO: 3384136 - protein, 26 aa, Plasmodium falciparum
IEKQYYMHDLPWVWHKNFYTGTSHFC

SEQ ID NO: 3384137 - protein, 17 aa, Plasmodium falciparum
IEKTRDLTKLSGYIWMR

SEQ ID NO: 3384138 - protein, 17 aa, Plasmodium falciparum
IEKVIIRVKRRIDDTSI

SEQ ID NO: 3384139 - protein, 28 aa, Plasmodium falciparum
IEKVNYFHYALMYMYNYLLKHKHFNYTN

SEQ ID NO: 3384140 - protein, 39 aa, Plasmodium falciparum
IEKYIIVFMDISNTYYFYKYMMYCYIKGNLISYKYIDIY

SEQ ID NO: 3384141 - protein, 42 aa, Plasmodium falciparum
IEKYKRVHVLYLGRLLQIVEKLFKKYILKYSFHKLRIFYEYK

SEQ ID NO: 3384142 - protein, 29 aa, Plasmodium falciparum
IELFVDPSEFFVFFNISYKLITNERKKKT

SEQ ID NO: 3384143 - protein, 26 aa, Plasmodium falciparum
IELKVSYTEFLWRSFRRIDISTFNLK

SEQ ID NO: 3384144 - protein, 25 aa, Plasmodium falciparum
IELNKKFLNNYFHACYFECSDNPML

SEQ ID NO: 3384145 - protein, 18 aa, Plasmodium falciparum
IELNLDYPSITYLNVSHN

SEQ ID NO: 3384146 - protein, 29 aa, Plasmodium falciparum
IELPNLIDYCYLYYLYSMTIANSNLSRIN

SEQ ID NO: 3384147 - protein, 32 aa, Plasmodium falciparum
IELRATENLYKTALCESFIKGKCFSGQFCRYA

SEQ ID NO: 3384148 - protein, 20 aa, Plasmodium falciparum
IELRHSYYSSVLILVNDNSE

SEQ ID NO: 3384149 - protein, 36 aa, Plasmodium falciparum
IEMNNSYLVLKTYKMKCSFFLNIIKNYEENIHILEN

SEQ ID NO: 3384150 - protein, 17 aa, Plasmodium falciparum
IEMWIALARLCTYTEAQ

SEQ ID NO: 3384151 - protein, 23 aa, Plasmodium falciparum
IEMYKFFELMNSFGIILTNDEKA

SEQ ID NO: 3384152 - protein, 36 aa, Plasmodium falciparum
IENERDLNFYIKIFNFLFEIITGKNIYYQINDIHNI

SEQ ID NO: 3384153 - protein, 28 aa, Plasmodium falciparum
IENHNLDEYFFLNSKNSFNLIQHIPDSI

SEQ ID NO: 3384154 - protein, 32 aa, Plasmodium falciparum
IENKKVIHYKPQNVFISFKYSKDNIFPTNEKL

SEQ ID NO: 3384155 - protein, 17 aa, Plasmodium falciparum
IENLLSHSGTKSDNFQS

SEQ ID NO: 3384156 - protein, 17 aa, Plasmodium falciparum
IENLLYLSLQSYAQEKS

SEQ ID NO: 3384157 - protein, 19 aa, Plasmodium falciparum
IENSIYYDNKMYLGANEKT

SEQ ID NO: 3384158 - protein, 40 aa, Plasmodium falciparum
IENSNQIKMPYLTNYLIVLFLPKYRLLALINICKTSIKVN

SEQ ID NO: 3384159 - protein, 17 aa, Plasmodium falciparum
IENYNGDKLLYIKNPWG

SEQ ID NO: 3384160 - protein, 19 aa, Plasmodium falciparum
IEPILLMDPMQRRESINKL

SEQ ID NO: 3384161 - protein, 31 aa, Plasmodium falciparum
IEQLIKYKTFNILKCLFFLAQWYKRNCRYLF

SEQ ID NO: 3384162 - protein, 22 aa, Plasmodium falciparum
IEQTILERAKVKMVLDTLVVQG

SEQ ID NO: 3384163 - protein, 23 aa, Plasmodium falciparum
IERKHTFLFNDIKSMFVNVENVN

SEQ ID NO: 3384164 - protein, 18 aa, Plasmodium falciparum
IERKKEVKRLIKYKTPRA

SEQ ID NO: 3384165 - protein, 17 aa, Plasmodium falciparum
IERNKLDIYMFEEKYKD

SEQ ID NO: 3384166 - protein, 23 aa, Plasmodium falciparum
IERQVCIPMHLPISYSINIEENE

SEQ ID NO: 3384167 - protein, 53 aa, Plasmodium falciparum
IERSTIINELLFYYTYYYEYSKEMIKYLYYIFDIKELYLFLEINNMPKEIHLR

SEQ ID NO: 3384168 - protein, 26 aa, Plasmodium falciparum
IERVCCYIKHFIEPPEPLFEVMVNVF

SEQ ID NO: 3384169 - protein, 28 aa, Plasmodium falciparum
IERYTPDDIWFLNKINTLFLSVGELLDE

SEQ ID NO: 3384170 - protein, 24 aa, Plasmodium falciparum
IESDLYYLYKLLINSRTIEQIRLE

SEQ ID NO: 3384171 - protein, 21 aa, Plasmodium falciparum
IESLQHTHLYGRHLIIDFADD

SEQ ID NO: 3384172 - protein, 17 aa, Plasmodium falciparum
IESNKIHQIKILASYKL

SEQ ID NO: 3384173 - protein, 33 aa, Plasmodium falciparum
IESNKNDLINFYKDPINFLFICNQTEKRIKEIE

SEQ ID NO: 3384174 - protein, 28 aa, Plasmodium falciparum
IESSSKLIFIDKLLCQLHYENCKYVKNY

SEQ ID NO: 3384175 - protein, 17 aa, Plasmodium falciparum
IESVNFMKGKNLFIVKF

SEQ ID NO: 3384176 - protein, 41 aa, Plasmodium falciparum
IETAKKDNILLKKKLKRSTDPLFLLTLEQKNKQLCIDIENR

SEQ ID NO: 3384177 - protein, 26 aa, Plasmodium falciparum
IETDKIIFPDVLFLIGSLSVVKEIKI

SEQ ID NO: 3384178 - protein, 27 aa, Plasmodium falciparum
IETNKNFHLFLSHLNQLEKSILTFTHF

SEQ ID NO: 3384179 - protein, 33 aa, Plasmodium falciparum
IEVEKYIPRLVPVNVYVPRYFGISAKAKGEPEE

SEQ ID NO: 3384180 - protein, 21 aa, Plasmodium falciparum
IEVINYLLREGKKVYFITNNS

SEQ ID NO: 3384181 - protein, 22 aa, Plasmodium falciparum
IEVLNEYNFLTAKPVVYLVNMS

SEQ ID NO: 3384182 - protein, 17 aa, Plasmodium falciparum
IEVLQLEELKDICVVDM

SEQ ID NO: 3384183 - protein, 26 aa, Plasmodium falciparum
IEVTKRLFHYWKLTKHSWAYQFCVDM

SEQ ID NO: 3384184 - protein, 23 aa, Plasmodium falciparum
IEVYFPYELYDCQYNYMLSVLSA

SEQ ID NO: 3384185 - protein, 26 aa, Plasmodium falciparum
IEYFNDLYIYIINSNIWINLTNVYMD

SEQ ID NO: 3384186 - protein, 18 aa, Plasmodium falciparum
IEYKLYLEREEEGSFIFI

SEQ ID NO: 3384187 - protein, 28 aa, Plasmodium falciparum
IEYLRTNPLIFIDTLNNLLIIPGINFEY

SEQ ID NO: 3384188 - protein, 32 aa, Plasmodium falciparum
IEYMILCAFTRLYKKEILPKTLYVIILEINKF

SEQ ID NO: 3384189 - protein, 18 aa, Plasmodium falciparum
IEYYNLRTQIKWINDVLI

SEQ ID NO: 3384190 - protein, 18 aa, Plasmodium falciparum
IFAKILDHLLKTDLYNIS

SEQ ID NO: 3384191 - protein, 26 aa, Plasmodium falciparum
IFCLCHDKFFTIWDTVTLKTLAIIKH

SEQ ID NO: 3384192 - protein, 22 aa, Plasmodium falciparum
IFDELHYGTLSPPSLYIHKYNK

SEQ ID NO: 3384193 - protein, 19 aa, Plasmodium falciparum
IFDGVVSISALQWLCNWDK

SEQ ID NO: 3384194 - protein, 24 aa, Plasmodium falciparum
IFDIIVCIPYGVLIFFSSYSSMTE

SEQ ID NO: 3384195 - protein, 26 aa, Plasmodium falciparum
IFDYDYKHFFFRYNDLTYIKDIKLDI

SEQ ID NO: 3384196 - protein, 25 aa, Plasmodium falciparum
IFEENGYILKKMNIKYLITENANIT

SEQ ID NO: 3384197 - protein, 17 aa, Plasmodium falciparum
IFEFEKYLNIVKNKIKN

SEQ ID NO: 3384198 - protein, 17 aa, Plasmodium falciparum
IFEFIKKVNKNITYIRL

SEQ ID NO: 3384199 - protein, 21 aa, Plasmodium falciparum
IFEFIKLITNGLYNFKLFNVS

SEQ ID NO: 3384200 - protein, 23 aa, Plasmodium falciparum
IFENALLYLKKNGKIVYITCSIL

SEQ ID NO: 3384201 - protein, 18 aa, Plasmodium falciparum
IFFFCSIEYLKINFCKDC

SEQ ID NO: 3384202 - protein, 18 aa, Plasmodium falciparum
IFFFYPFNNSRDNEKNED

SEQ ID NO: 3384203 - protein, 21 aa, Plasmodium falciparum
IFFIYLIYVRSHFSQPTSSEY

SEQ ID NO: 3384204 - protein, 18 aa, Plasmodium falciparum
IFFKIIYCMNKGLSLLIN

SEQ ID NO: 3384205 - protein, 17 aa, Plasmodium falciparum
IFHMKNSVDIHFKHDLA

SEQ ID NO: 3384206 - protein, 17 aa, Plasmodium falciparum
IFHNMLPYIKYIDDWIK

SEQ ID NO: 3384207 - protein, 25 aa, Plasmodium falciparum
IFHTHMFELFVRLIFENSRTYFTIF

SEQ ID NO: 3384208 - protein, 18 aa, Plasmodium falciparum
IFIEALFIDSLSFWNFCK

SEQ ID NO: 3384209 - protein, 19 aa, Plasmodium falciparum
IFIFNLSTFVFYKTVQLPK

SEQ ID NO: 3384210 - protein, 21 aa, Plasmodium falciparum
IFINEIFYKYHHAPIFLLVNV

SEQ ID NO: 3384211 - protein, 19 aa, Plasmodium falciparum
IFINTGNNPYFLRSNNKKR

SEQ ID NO: 3384212 - protein, 18 aa, Plasmodium falciparum
IFIPFIKCKKKKAKINKW

SEQ ID NO: 3384213 - protein, 20 aa, Plasmodium falciparum
IFKKALFILRQKVINVKEAL

SEQ ID NO: 3384214 - protein, 21 aa, Plasmodium falciparum
IFKKYIDLSTNYWGAKYIILN

SEQ ID NO: 3384215 - protein, 26 aa, Plasmodium falciparum
IFKMVNLSYILKIYKLPEDLTFKNSE

SEQ ID NO: 3384216 - protein, 26 aa, Plasmodium falciparum
IFKNNEYIFKNRNLEFLKNDKKKKFQ

SEQ ID NO: 3384217 - protein, 19 aa, Plasmodium falciparum
IFKRAMIIKKWFNNLSKVT

SEQ ID NO: 3384218 - protein, 30 aa, Plasmodium falciparum
IFKVHKNGLITYWPFIRSDGSHILDVYKKQ

SEQ ID NO: 3384219 - protein, 24 aa, Plasmodium falciparum
IFLESELFYKGIIPAINVGLSVSR

SEQ ID NO: 3384220 - protein, 17 aa, Plasmodium falciparum
IFLFDTFYKVSVTDNVK

SEQ ID NO: 3384221 - protein, 20 aa, Plasmodium falciparum
IFLNKMNLTEEQKMFFLKQL

SEQ ID NO: 3384222 - protein, 18 aa, Plasmodium falciparum
IFLNVFLYVERLFDIIEP

SEQ ID NO: 3384223 - protein, 18 aa, Plasmodium falciparum
IFLRIFNILKIPAYHKTS

SEQ ID NO: 3384224 - protein, 20 aa, Plasmodium falciparum
IFMDKLIYYCTNPIIFLMQR

SEQ ID NO: 3384225 - protein, 34 aa, Plasmodium falciparum
IFMNNIFLIKYVLKYKHIFSNNLYLYILNVFCNT

SEQ ID NO: 3384226 - protein, 17 aa, Plasmodium falciparum
IFNALSKTYGYLTPDLW

SEQ ID NO: 3384227 - protein, 17 aa, Plasmodium falciparum
IFNIIKKLQGGKQLCII

SEQ ID NO: 3384228 - protein, 23 aa, Plasmodium falciparum
IFNNEEIFFNSKKINMDKGSNAK

SEQ ID NO: 3384229 - protein, 43 aa, Plasmodium falciparum
IFNSDSRFCFLEFRTVQITWLCLKLDSIPYNNYCLRIGRPHDY

SEQ ID NO: 3384230 - protein, 24 aa, Plasmodium falciparum
IFNVKMFSLINKYMNLYLPNFTKN

SEQ ID NO: 3384231 - protein, 20 aa, Plasmodium falciparum
IFPNKIYLYMSGYNDMEYIK

SEQ ID NO: 3384232 - protein, 29 aa, Plasmodium falciparum
IFPNNIMMDNSPYYKFRHSNKKPSYGSES

SEQ ID NO: 3384233 - protein, 22 aa, Plasmodium falciparum
IFPSVYNIRFHIVTKFCLITQK

SEQ ID NO: 3384234 - protein, 18 aa, Plasmodium falciparum
IFQIIKKRPEIYNPHIDI

SEQ ID NO: 3384235 - protein, 20 aa, Plasmodium falciparum
IFQIQLNEENFNALAALENE

SEQ ID NO: 3384236 - protein, 18 aa, Plasmodium falciparum
IFQKENIHLKNHLDFIYN

SEQ ID NO: 3384237 - protein, 20 aa, Plasmodium falciparum
IFQNSRFMDHTGACDTIKSG

SEQ ID NO: 3384238 - protein, 21 aa, Plasmodium falciparum
IFQYMYKLLHIILTRKKQIDS

SEQ ID NO: 3384239 - protein, 32 aa, Plasmodium falciparum
IFRNIQITDILSRYTWCLSDELPKLISSVNII

SEQ ID NO: 3384240 - protein, 27 aa, Plasmodium falciparum
IFSCPKNFFLFFYYKSKNNLFNYKDMY

SEQ ID NO: 3384241 - protein, 25 aa, Plasmodium falciparum
IFSPDLFWNICLYFKDNIMGVDPSL

SEQ ID NO: 3384242 - protein, 24 aa, Plasmodium falciparum
IFSVEFLVYRLLEFSLQHTYENIR

SEQ ID NO: 3384243 - protein, 17 aa, Plasmodium falciparum
IFTINICKSLWILLSIT

SEQ ID NO: 3384244 - protein, 18 aa, Plasmodium falciparum
IFTNIIVCLYRIANNING

SEQ ID NO: 3384245 - protein, 19 aa, Plasmodium falciparum
IFTNLIKNLYKAKNLRILC

SEQ ID NO: 3384246 - protein, 19 aa, Plasmodium falciparum
IFTPIYYFDGNSWTALERL

SEQ ID NO: 3384247 - protein, 17 aa, Plasmodium falciparum
IFTYSVLLCNRISFPHN

SEQ ID NO: 3384248 - protein, 27 aa, Plasmodium falciparum
IFVGNIPIKDVSISKLLKILNIEKSIV

SEQ ID NO: 3384249 - protein, 21 aa, Plasmodium falciparum
IFYIIIIFYNIEKVNNYKSSC

SEQ ID NO: 3384250 - protein, 18 aa, Plasmodium falciparum
IFYLRFSKCISKNNNYGY

SEQ ID NO: 3384251 - protein, 25 aa, Plasmodium falciparum
IGCCYFFRKYFGRNIGLHLGLTSLR

SEQ ID NO: 3384252 - protein, 27 aa, Plasmodium falciparum
IGCFVPCTYAKIPIFTQIMCRVGSSDI

SEQ ID NO: 3384253 - protein, 27 aa, Plasmodium falciparum
IGCGNGLFLYKLYEKGFMNLYGFDFSS

SEQ ID NO: 3384254 - protein, 31 aa, Plasmodium falciparum
IGCSYISITNLLNLGLEGGVFLLVEEYKNEY

SEQ ID NO: 3384255 - protein, 29 aa, Plasmodium falciparum
IGDMIRTQFPHSQFIIVSLKEGMFSHADV

SEQ ID NO: 3384256 - protein, 26 aa, Plasmodium falciparum
IGDNNNVFSFYNFKANKLTNLTNHNN

SEQ ID NO: 3384257 - protein, 21 aa, Plasmodium falciparum
IGEFFNDLTAWLKKNPTVYDS

SEQ ID NO: 3384258 - protein, 20 aa, Plasmodium falciparum
IGFELMLKLLSERKFLCFPS

SEQ ID NO: 3384259 - protein, 25 aa, Plasmodium falciparum
IGFENIIYLLYKLLKKKYITCPLKS

SEQ ID NO: 3384260 - protein, 22 aa, Plasmodium falciparum
IGFTAIRHLGRIKNLLTNVSSN

SEQ ID NO: 3384261 - protein, 19 aa, Plasmodium falciparum
IGHPFMYPKMDITKMNKTN

SEQ ID NO: 3384262 - protein, 19 aa, Plasmodium falciparum
IGICTYYNKLNKQKNHIIT

SEQ ID NO: 3384263 - protein, 17 aa, Plasmodium falciparum
IGIVELYKNSLSSKAVN

SEQ ID NO: 3384264 - protein, 17 aa, Plasmodium falciparum
IGIYHKFMKLKDNDFNI

SEQ ID NO: 3384265 - protein, 27 aa, Plasmodium falciparum
IGKDITWFHTVIFPTILLSANIPLSKS

SEQ ID NO: 3384266 - protein, 20 aa, Plasmodium falciparum
IGKIYVTISPYPSKSILPAQ

SEQ ID NO: 3384267 - protein, 25 aa, Plasmodium falciparum
IGKKKALMITLNYNGLLEGCVNDTV

SEQ ID NO: 3384268 - protein, 19 aa, Plasmodium falciparum
IGKVFFLLDPFKEFAFVNS

SEQ ID NO: 3384269 - protein, 26 aa, Plasmodium falciparum
IGLKYDNMWGIFRFVIDNLADKPNGN

SEQ ID NO: 3384270 - protein, 24 aa, Plasmodium falciparum
IGLSKKHFLRVLKKIKPQTSESLI

SEQ ID NO: 3384271 - protein, 21 aa, Plasmodium falciparum
IGLSNFKFVSPVYGVLAACVM

SEQ ID NO: 3384272 - protein, 25 aa, Plasmodium falciparum
IGNIKLDYVVLYIYGICIFNNDIIN

SEQ ID NO: 3384273 - protein, 23 aa, Plasmodium falciparum
IGNNALIYLLGYSTNKHKKILIK

SEQ ID NO: 3384274 - protein, 24 aa, Plasmodium falciparum
IGQEYFIYIHKRSKIKDYCPSYYS

SEQ ID NO: 3384275 - protein, 26 aa, Plasmodium falciparum
IGQTNLFIWLHYDIPDNFLIQIKGRK

SEQ ID NO: 3384276 - protein, 19 aa, Plasmodium falciparum
IGQVIKNMHILRAIEMLPT

SEQ ID NO: 3384277 - protein, 24 aa, Plasmodium falciparum
IGRTYKPFNPLLGETYELTHRKFR

SEQ ID NO: 3384278 - protein, 24 aa, Plasmodium falciparum
IGSLPVVFMELLKRKKKVPIICHE

SEQ ID NO: 3384279 - protein, 28 aa, Plasmodium falciparum
IGTIHSFCRYILYKYKGTFKILTDFINT

SEQ ID NO: 3384280 - protein, 28 aa, Plasmodium falciparum
IGTKKYPLDFFLWLLNKIYRHSNKMLKK

SEQ ID NO: 3384281 - protein, 25 aa, Plasmodium falciparum
IGTLIRSCFLLKWQCIFNIDNLNRK

SEQ ID NO: 3384282 - protein, 26 aa, Plasmodium falciparum
IGTYKKWMNILKRSNFLYIYNSINTI

SEQ ID NO: 3384283 - protein, 29 aa, Plasmodium falciparum
IGYTPVFSPTWDVREIPRVIPKYEGEQKI

SEQ ID NO: 3384284 - protein, 26 aa, Plasmodium falciparum
IHACDNLIYNILYWREELAKKLDEAP

SEQ ID NO: 3384285 - protein, 26 aa, Plasmodium falciparum
IHANIFFGDLVLLKFIPKETAKNDTQ

SEQ ID NO: 3384286 - protein, 18 aa, Plasmodium falciparum
IHAVARWKWIGSTIDSVC

SEQ ID NO: 3384287 - protein, 39 aa, Plasmodium falciparum
IHCSGHLLMVAFTDKLRIFHILYNKLKIKKEFFLKNCSC

SEQ ID NO: 3384288 - protein, 18 aa, Plasmodium falciparum
IHCVKTIRKLNHKAILIN

SEQ ID NO: 3384289 - protein, 17 aa, Plasmodium falciparum
IHDKELLSHILNSNSES

SEQ ID NO: 3384290 - protein, 29 aa, Plasmodium falciparum
IHEDSGSLVFFNTLKKELLYDKPADFYEP

SEQ ID NO: 3384291 - protein, 25 aa, Plasmodium falciparum
IHEEEIPFEIYLKDFYPIEKICELI

SEQ ID NO: 3384292 - protein, 26 aa, Plasmodium falciparum
IHEKKRIFFEVYKKYYFIEMTEYHKS

SEQ ID NO: 3384293 - protein, 19 aa, Plasmodium falciparum
IHETIINSMKFITISNNIT

SEQ ID NO: 3384294 - protein, 18 aa, Plasmodium falciparum
IHFEDAMEIIYKMGYVPS

SEQ ID NO: 3384295 - protein, 19 aa, Plasmodium falciparum
IHFQNYKCNFINADLSPFL

SEQ ID NO: 3384296 - protein, 26 aa, Plasmodium falciparum
IHFVNKKYFSLVKIKYVIVDEFDLLF

SEQ ID NO: 3384297 - protein, 37 aa, Plasmodium falciparum
IHHFNKPLNDFLEIDIKLLRWLTTIMIKTSNSLNDID

SEQ ID NO: 3384298 - protein, 27 aa, Plasmodium falciparum
IHHKRARYFFNFFQVYGILSEESSDYD

SEQ ID NO: 3384299 - protein, 21 aa, Plasmodium falciparum
IHIHKNICDHLTSGNIYNGKK

SEQ ID NO: 3384300 - protein, 17 aa, Plasmodium falciparum
IHIILSSLNFDENLELD

SEQ ID NO: 3384301 - protein, 23 aa, Plasmodium falciparum
IHINVINKYKLHISLKNDEFIFF

SEQ ID NO: 3384302 - protein, 18 aa, Plasmodium falciparum
IHKEYFSNSIFRKYTHHK

SEQ ID NO: 3384303 - protein, 19 aa, Plasmodium falciparum
IHKEYIILYNKYSSKFKFT

SEQ ID NO: 3384304 - protein, 64 aa, Plasmodium falciparum
IHKNKDLLTLFKKKDLANLKKKNLSFFMDTLKLEKIDMLIMKRIQMCLEKIKNTLLLTCTINNV

SEQ ID NO: 3384305 - protein, 17 aa, Plasmodium falciparum
IHKPNIKQEFYIYRDLK

SEQ ID NO: 3384306 - protein, 28 aa, Plasmodium falciparum
IHKYNWMYEDFYVNRLISQIMKKKKKKK

SEQ ID NO: 3384307 - protein, 20 aa, Plasmodium falciparum
IHLFHELIYSLLFSKHQKEK

SEQ ID NO: 3384308 - protein, 19 aa, Plasmodium falciparum
IHLGIIDKILLLNEDRKKC

SEQ ID NO: 3384309 - protein, 19 aa, Plasmodium falciparum
IHLIKNNSIIFSNSLSPNE

SEQ ID NO: 3384310 - protein, 27 aa, Plasmodium falciparum
IHLKNKKNLYRLLGINFTKDIKNKIKC

SEQ ID NO: 3384311 - protein, 17 aa, Plasmodium falciparum
IHLLEILCGYSHDYLRD

SEQ ID NO: 3384312 - protein, 30 aa, Plasmodium falciparum
IHLSSLKINDWGLSILIPCILRSRKLTTLN

SEQ ID NO: 3384313 - protein, 17 aa, Plasmodium falciparum
IHLYSPFCDSDILICSP

SEQ ID NO: 3384314 - protein, 19 aa, Plasmodium falciparum
IHMNNSFVNFINGNNVKKN

SEQ ID NO: 3384315 - protein, 18 aa, Plasmodium falciparum
IHNEFLLNNSFDNSIEHV

SEQ ID NO: 3384316 - protein, 26 aa, Plasmodium falciparum
IHNELESFHFFPVEKHTYVTVQNFIS

SEQ ID NO: 3384317 - protein, 28 aa, Plasmodium falciparum
IHNFKIRNFLNFKLYNSIFDTIREKNRS

SEQ ID NO: 3384318 - protein, 25 aa, Plasmodium falciparum
IHNHLHYFSLYYLTDIIYNIAILNC

SEQ ID NO: 3384319 - protein, 18 aa, Plasmodium falciparum
IHNNEELFSFDRNFKKKN

SEQ ID NO: 3384320 - protein, 17 aa, Plasmodium falciparum
IHNTPNILPNRHNSMYP

SEQ ID NO: 3384321 - protein, 19 aa, Plasmodium falciparum
IHPNILRTGIFFNKCSITT

SEQ ID NO: 3384322 - protein, 23 aa, Plasmodium falciparum
IHPQIICDGFRMALASAREALLD

SEQ ID NO: 3384323 - protein, 21 aa, Plasmodium falciparum
IHPRIITQGFDIAKGILLEFL

SEQ ID NO: 3384324 - protein, 25 aa, Plasmodium falciparum
IHPSVPKLYNLYWGYSIEILKNLSD

SEQ ID NO: 3384325 - protein, 24 aa, Plasmodium falciparum
IHPVWTVYMNRFSLFKQVYTHRKV

SEQ ID NO: 3384326 - protein, 25 aa, Plasmodium falciparum
IHQASNLLYQNLLNNPQSLLQHLNL

SEQ ID NO: 3384327 - protein, 26 aa, Plasmodium falciparum
IHQCSDFHLILFVAKVLDIETALALC

SEQ ID NO: 3384328 - protein, 19 aa, Plasmodium falciparum
IHRDIKIANLLIDNNGILK

SEQ ID NO: 3384329 - protein, 17 aa, Plasmodium falciparum
IHRDYVHSYHMKKKQKK

SEQ ID NO: 3384330 - protein, 19 aa, Plasmodium falciparum
IHRYYPLDMKMHSNIYLYD

SEQ ID NO: 3384331 - protein, 25 aa, Plasmodium falciparum
IHSFHTMKASYYNGCNLNKGGRYFK

SEQ ID NO: 3384332 - protein, 18 aa, Plasmodium falciparum
IHTIKRLNSLFKIPIDDI

SEQ ID NO: 3384333 - protein, 28 aa, Plasmodium falciparum
IHTKTTHWSYENLQLHGKKYSSFNLKND

SEQ ID NO: 3384334 - protein, 35 aa, Plasmodium falciparum
IHTLTLCLDLFINSILYPYIFYIHELNVQNKNMTE

SEQ ID NO: 3384335 - protein, 23 aa, Plasmodium falciparum
IHTNRILCQLLNNQNLKLNWIKE

SEQ ID NO: 3384336 - protein, 24 aa, Plasmodium falciparum
IHVERMMLHCWIILKNKELNNLKK

SEQ ID NO: 3384337 - protein, 17 aa, Plasmodium falciparum
IHVKTIKSSLHISVYKS

SEQ ID NO: 3384338 - protein, 18 aa, Plasmodium falciparum
IHVLWHEMGPDKTKDFLS

SEQ ID NO: 3384339 - protein, 18 aa, Plasmodium falciparum
IIAQILSILLKFDKKSFD

SEQ ID NO: 3384340 - protein, 18 aa, Plasmodium falciparum
IIARAKSMKMKRIGTINF

SEQ ID NO: 3384341 - protein, 44 aa, Plasmodium falciparum
IIASEELYSLPNSYPFFLIYYVSFCYRNSINAWNGWPSFNDLYK

SEQ ID NO: 3384342 - protein, 18 aa, Plasmodium falciparum
IICHFYAQCLRTLQEYDS

SEQ ID NO: 3384343 - protein, 24 aa, Plasmodium falciparum
IICISCFKCYFPFEFVNKCVICNS

SEQ ID NO: 3384344 - protein, 18 aa, Plasmodium falciparum
IICMPGYIDFALSDIDLT

SEQ ID NO: 3384345 - protein, 24 aa, Plasmodium falciparum
IICNKIIHEPLKNISFHNHLADHT

SEQ ID NO: 3384346 - protein, 19 aa, Plasmodium falciparum
IICSILLSRNIKKANYLVF

SEQ ID NO: 3384347 - protein, 17 aa, Plasmodium falciparum
IIDCAFTIAFNEKYDNL

SEQ ID NO: 3384348 - protein, 24 aa, Plasmodium falciparum
IIDDSTLTIYFYKLNIMKYHDTIE

SEQ ID NO: 3384349 - protein, 25 aa, Plasmodium falciparum
IIDIYNFFDILLNNNIPYYDFKIVQ

SEQ ID NO: 3384350 - protein, 33 aa, Plasmodium falciparum
IIDKALLRSGRFDQLIYISLPKYQGRVDILKKL

SEQ ID NO: 3384351 - protein, 25 aa, Plasmodium falciparum
IIDKNFILFYECLLKILLNIKFVNF

SEQ ID NO: 3384352 - protein, 24 aa, Plasmodium falciparum
IIDKNYIFKLPTAFFDTLGIFNVS

SEQ ID NO: 3384353 - protein, 18 aa, Plasmodium falciparum
IIDQIIFFNFIFTSDMMY

SEQ ID NO: 3384354 - protein, 19 aa, Plasmodium falciparum
IIDVKKQKFIIGSSYRKCD

SEQ ID NO: 3384355 - protein, 25 aa, Plasmodium falciparum
IIECVEILPQLKYGLDVNCKFTNIC

SEQ ID NO: 3384356 - protein, 31 aa, Plasmodium falciparum
IIEDDILIKTIPFPTFLFSDNIKKTKDINED

SEQ ID NO: 3384357 - protein, 33 aa, Plasmodium falciparum
IIEEPYKIKLLERKKWLWKTIIEIHMLILEEQR

SEQ ID NO: 3384358 - protein, 33 aa, Plasmodium falciparum
IIEERKIFYVGITRAKFLLYLLCSIQNNNSEKN

SEQ ID NO: 3384359 - protein, 18 aa, Plasmodium falciparum
IIEIIKYNKFYDLCVFSD

SEQ ID NO: 3384360 - protein, 28 aa, Plasmodium falciparum
IIEKIKLNEFFFRIKVYMTSHMDELKKN

SEQ ID NO: 3384361 - protein, 29 aa, Plasmodium falciparum
IIEKKVPLIVERVVPVLKVNRVEKEILTN

SEQ ID NO: 3384362 - protein, 23 aa, Plasmodium falciparum
IIEKYKLYKFLKKKKIEGYMILN

SEQ ID NO: 3384363 - protein, 26 aa, Plasmodium falciparum
IIELVYKIIHIYLFQDLTDMQNIQKK

SEQ ID NO: 3384364 - protein, 25 aa, Plasmodium falciparum
IIEMTLYNWMVFSGPITLRANKGIN

SEQ ID NO: 3384365 - protein, 20 aa, Plasmodium falciparum
IIENDVFPKILYLLKDNDDI

SEQ ID NO: 3384366 - protein, 30 aa, Plasmodium falciparum
IIENHDVILIYTFDYDIYLSIIKAKRNGKK

SEQ ID NO: 3384367 - protein, 48 aa, Plasmodium falciparum
IIENVSNVFNYVKNIYFVIIKNEKMMFYFLYNTKDVLNNIIYMENENK

SEQ ID NO: 3384368 - protein, 26 aa, Plasmodium falciparum
IIERLNEYYFCKIFQMPPAFSEGQNI

SEQ ID NO: 3384369 - protein, 36 aa, Plasmodium falciparum
IIEYLPPICESFLRYVLDIIILNPLHDIILSYDNNK

SEQ ID NO: 3384370 - protein, 19 aa, Plasmodium falciparum
IIFEKKKRIKSLKRNVILF

SEQ ID NO: 3384371 - protein, 23 aa, Plasmodium falciparum
IIFLMKHELKFLNYLKFYNIPIN

SEQ ID NO: 3384372 - protein, 19 aa, Plasmodium falciparum
IIFLNIYSLTHKRIYSILN

SEQ ID NO: 3384373 - protein, 18 aa, Plasmodium falciparum
IIFNRINNDILRDINMKK

SEQ ID NO: 3384374 - protein, 20 aa, Plasmodium falciparum
IIFYIFIHVTNKKSQVLFSV

SEQ ID NO: 3384375 - protein, 17 aa, Plasmodium falciparum
IIGLSKFSRIVDVFSRR

SEQ ID NO: 3384376 - protein, 25 aa, Plasmodium falciparum
IIGNILIFHYKYFECIMKLYKVYEG

SEQ ID NO: 3384377 - protein, 24 aa, Plasmodium falciparum
IIGNVLFPRFLSWEMKNNVNRLNL

SEQ ID NO: 3384378 - protein, 24 aa, Plasmodium falciparum
IIGQKYYLCFINQLIKHWKILNKK

SEQ ID NO: 3384379 - protein, 20 aa, Plasmodium falciparum
IIGRQYAIMKAFSILEALKE

SEQ ID NO: 3384380 - protein, 28 aa, Plasmodium falciparum
IIGTPGRILALIREKYLITDKIQHFVLD

SEQ ID NO: 3384381 - protein, 19 aa, Plasmodium falciparum
IIHFLSELQFLFTDKNFKV

SEQ ID NO: 3384382 - protein, 19 aa, Plasmodium falciparum
IIHIPKIEYRNKIVEIPVY

SEQ ID NO: 3384383 - protein, 19 aa, Plasmodium falciparum
IIHLNFNTNILYYDSTCPH

SEQ ID NO: 3384384 - protein, 34 aa, Plasmodium falciparum
IIHNKTNSHDLLWVPRCCNGSYGTFLKYNYSNMN

SEQ ID NO: 3384385 - protein, 30 aa, Plasmodium falciparum
IIHTKGIIPQIYYKIYFLADMENFDKKNYY

SEQ ID NO: 3384386 - protein, 24 aa, Plasmodium falciparum
IIIDNSFLHYSLKKYYHNINEDQQ

SEQ ID NO: 3384387 - protein, 19 aa, Plasmodium falciparum
IIIFYVCLHNFLKTSLNID

SEQ ID NO: 3384388 - protein, 19 aa, Plasmodium falciparum
IIINGFPRNYEQALLIIQN

SEQ ID NO: 3384389 - protein, 19 aa, Plasmodium falciparum
IIIPIITGYTHKFVPKWDI

SEQ ID NO: 3384390 - protein, 28 aa, Plasmodium falciparum
IIIPKGSYLYELIYPQTIHSFPVINKFN

SEQ ID NO: 3384391 - protein, 20 aa, Plasmodium falciparum
IIISKWFTIKEIKWIDNYYT

SEQ ID NO: 3384392 - protein, 17 aa, Plasmodium falciparum
IIIYLNTVGMEEELSLD

SEQ ID NO: 3384393 - protein, 25 aa, Plasmodium falciparum
IIKCRKILKWSYTYAYFSNWKSDNQ

SEQ ID NO: 3384394 - protein, 42 aa, Plasmodium falciparum
IIKDKIVNVILRPDLFTGLNRAAKGILLFGPPGTGKTMVAKW

SEQ ID NO: 3384395 - protein, 27 aa, Plasmodium falciparum
IIKFIRHFEGIYTPKLKILSKLKTKNV

SEQ ID NO: 3384396 - protein, 20 aa, Plasmodium falciparum
IIKKKIVFPKNRVNKFSTSV

SEQ ID NO: 3384397 - protein, 22 aa, Plasmodium falciparum
IIKKMYIFRYLTDKQCNLLIEA

SEQ ID NO: 3384398 - protein, 27 aa, Plasmodium falciparum
IIKKNFKLPCWIKIKNLRKNDLSNLTY

SEQ ID NO: 3384399 - protein, 19 aa, Plasmodium falciparum
IIKKNSYTYKVKDHSYYNY

SEQ ID NO: 3384400 - protein, 24 aa, Plasmodium falciparum
IIKKYNFLFVCCESPIIIYSDLKK

SEQ ID NO: 3384401 - protein, 20 aa, Plasmodium falciparum
IIKLILCEDSKKKNLRNIIS

SEQ ID NO: 3384402 - protein, 39 aa, Plasmodium falciparum
IIKNEKTITLPYIYKLIPLKYFGYKHKIKNISLGSFHTL

SEQ ID NO: 3384403 - protein, 18 aa, Plasmodium falciparum
IIKNILELERRKYAINCI

SEQ ID NO: 3384404 - protein, 25 aa, Plasmodium falciparum
IIKNNKMFFVIPNIIRRVLTIIRVE

SEQ ID NO: 3384405 - protein, 21 aa, Plasmodium falciparum
IIKNYEIYTWLLTNCNMQTDE

SEQ ID NO: 3384406 - protein, 20 aa, Plasmodium falciparum
IIKSIYVIDDFVLVKILSNE

SEQ ID NO: 3384407 - protein, 24 aa, Plasmodium falciparum
IIKSVHVYIIDFAHASLNKNQNDE

SEQ ID NO: 3384408 - protein, 25 aa, Plasmodium falciparum
IIKVQKKYDILRRKSIEKMNLRGAN

SEQ ID NO: 3384409 - protein, 17 aa, Plasmodium falciparum
IIKYFKEKKVKSVVDVG

SEQ ID NO: 3384410 - protein, 17 aa, Plasmodium falciparum
IIKYIIVTGGNMSGLGK

SEQ ID NO: 3384411 - protein, 26 aa, Plasmodium falciparum
IIKYNIFHLTYILVYTRTLDKKTKVK

SEQ ID NO: 3384412 - protein, 17 aa, Plasmodium falciparum
IIKYVPRNSKNIDWEDE

SEQ ID NO: 3384413 - protein, 18 aa, Plasmodium falciparum
IILCLNPSELKYFLKKSK

SEQ ID NO: 3384414 - protein, 21 aa, Plasmodium falciparum
IILHEFCFINYLLTIDIYNNS

SEQ ID NO: 3384415 - protein, 34 aa, Plasmodium falciparum
IILKKFELILRDLIKIYFIRFLYFEKKEENISIL

SEQ ID NO: 3384416 - protein, 17 aa, Plasmodium falciparum
IILYIEYDDKHINKEIL

SEQ ID NO: 3384417 - protein, 18 aa, Plasmodium falciparum
IIMDDVSGVILFYEDVIN

SEQ ID NO: 3384418 - protein, 17 aa, Plasmodium falciparum
IIMHPDFVEKYLQNKKN

SEQ ID NO: 3384419 - protein, 25 aa, Plasmodium falciparum
IINCNHILLFIKNKLLLTNLSFPNF

SEQ ID NO: 3384420 - protein, 18 aa, Plasmodium falciparum
IINDKPSNFFNYIYNIES

SEQ ID NO: 3384421 - protein, 24 aa, Plasmodium falciparum
IINDLLQMVHVWKKLLINDMQETK

SEQ ID NO: 3384422 - protein, 18 aa, Plasmodium falciparum
IINDSTSFLFLRKQKKKK

SEQ ID NO: 3384423 - protein, 23 aa, Plasmodium falciparum
IINFDLPYILNRGTALNLKKLKF

SEQ ID NO: 3384424 - protein, 24 aa, Plasmodium falciparum
IINFESLCIIPGKKVWCICINIMV

SEQ ID NO: 3384425 - protein, 20 aa, Plasmodium falciparum
IINFRKSYLHILLETVNFKY

SEQ ID NO: 3384426 - protein, 24 aa, Plasmodium falciparum
IINHFKKFCIPNFLKSVGKDILNF

SEQ ID NO: 3384427 - protein, 28 aa, Plasmodium falciparum
IINISQPSCVGTYKTFKDFYTHKVLKKN

SEQ ID NO: 3384428 - protein, 34 aa, Plasmodium falciparum
IINIYRNQFLFDNKFRFLLYELQQLILPHLKKSV

SEQ ID NO: 3384429 - protein, 24 aa, Plasmodium falciparum
IINKIKELNIILLQNKDEIDNLKQ

SEQ ID NO: 3384430 - protein, 19 aa, Plasmodium falciparum
IINKLIGFNLYDIHIYNIY

SEQ ID NO: 3384431 - protein, 18 aa, Plasmodium falciparum
IINKLPNIQKTKSFLVCP

SEQ ID NO: 3384432 - protein, 20 aa, Plasmodium falciparum
IINLIILCEIKLNNLYISQK

SEQ ID NO: 3384433 - protein, 34 aa, Plasmodium falciparum
IINNDMLIYGYGKYLLFFCLKDMKFIKIIDDHQS

SEQ ID NO: 3384434 - protein, 30 aa, Plasmodium falciparum
IINNPSHRIYKPPVFISKYIKDMNEDELND

SEQ ID NO: 3384435 - protein, 17 aa, Plasmodium falciparum
IINNSIKTKGFSVKKLG

SEQ ID NO: 3384436 - protein, 24 aa, Plasmodium falciparum
IINPYEFFIAYNYIEWDGKYVFDF

SEQ ID NO: 3384437 - protein, 26 aa, Plasmodium falciparum
IINQKRYIYFLLLNKKEEKAHICICS

SEQ ID NO: 3384438 - protein, 25 aa, Plasmodium falciparum
IINTYIFDITWRIVRDWMLLKDVPE

SEQ ID NO: 3384439 - protein, 27 aa, Plasmodium falciparum
IINYQTLYLVCKYLLYHNKEQLVQELF

SEQ ID NO: 3384440 - protein, 21 aa, Plasmodium falciparum
IINYYIYDMFSFVIKGEGIQC

SEQ ID NO: 3384441 - protein, 17 aa, Plasmodium falciparum
IIPTLRFQYEINMKAYI

SEQ ID NO: 3384442 - protein, 17 aa, Plasmodium falciparum
IIPTTINSNWIYCPIDG

SEQ ID NO: 3384443 - protein, 17 aa, Plasmodium falciparum
IIPVIKYTDNIIYVDCC

SEQ ID NO: 3384444 - protein, 25 aa, Plasmodium falciparum
IIQERTNIIKISPNDTLYYETDNIK

SEQ ID NO: 3384445 - protein, 20 aa, Plasmodium falciparum
IIQLINNLEVYLRNKMNINI

SEQ ID NO: 3384446 - protein, 18 aa, Plasmodium falciparum
IIQLYDSFYYKEHLIIVT

SEQ ID NO: 3384447 - protein, 33 aa, Plasmodium falciparum
IIQPYKMPMYNPNAYPPHPFYMNNNFAPYNNMP

SEQ ID NO: 3384448 - protein, 19 aa, Plasmodium falciparum
IIRILKELYIKNEVFLIHI

SEQ ID NO: 3384449 - protein, 18 aa, Plasmodium falciparum
IIRILRFKNNLISQRLLI

SEQ ID NO: 3384450 - protein, 18 aa, Plasmodium falciparum
IIRILYAYYDICLNILKN

SEQ ID NO: 3384451 - protein, 20 aa, Plasmodium falciparum
IIRKIFIESNLLCHHIVKLK

SEQ ID NO: 3384452 - protein, 26 aa, Plasmodium falciparum
IIRKNEVIFILKKNDYLLVLISIHFV

SEQ ID NO: 3384453 - protein, 20 aa, Plasmodium falciparum
IIRNYIDIMKYIYQEIYNRI

SEQ ID NO: 3384454 - protein, 21 aa, Plasmodium falciparum
IISDIDIFCSFGFICCSSIST

SEQ ID NO: 3384455 - protein, 42 aa, Plasmodium falciparum
IISHFHMDHIGALPFFTEILKYRGIILMSYPTKALSPILLLD

SEQ ID NO: 3384456 - protein, 34 aa, Plasmodium falciparum
IISIENFSITNYYGKLFILAKKVTVYLNIDHFDI

SEQ ID NO: 3384457 - protein, 24 aa, Plasmodium falciparum
IISIPYICSRWYRAPELLCGSMFY

SEQ ID NO: 3384458 - protein, 17 aa, Plasmodium falciparum
IISITFKNFPGLNQKYC

SEQ ID NO: 3384459 - protein, 29 aa, Plasmodium falciparum
IISKYNVHYYPYELYFNSYKNIYQEEKVL

SEQ ID NO: 3384460 - protein, 27 aa, Plasmodium falciparum
IISLYFDLCEIWLIQGNYRAILLLKII

SEQ ID NO: 3384461 - protein, 24 aa, Plasmodium falciparum
IISNFLTDVKYDLLKKVKINLIYL

SEQ ID NO: 3384462 - protein, 19 aa, Plasmodium falciparum
IISSITKYPLPIKNSLDAY

SEQ ID NO: 3384463 - protein, 17 aa, Plasmodium falciparum
IISVLKIEKQRALQNIN

SEQ ID NO: 3384464 - protein, 24 aa, Plasmodium falciparum
IITHKIYHPQVKIVKVSCGKRIIG

SEQ ID NO: 3384465 - protein, 28 aa, Plasmodium falciparum
IITNRIDGFWVYKVSPLLKVKGILNITN

SEQ ID NO: 3384466 - protein, 20 aa, Plasmodium falciparum
IITPFNVWYRYKGEWKEDIE

SEQ ID NO: 3384467 - protein, 17 aa, Plasmodium falciparum
IIVICYQCNNRNITNIE

SEQ ID NO: 3384468 - protein, 19 aa, Plasmodium falciparum
IIVLLLSINKPNDSILYSK

SEQ ID NO: 3384469 - protein, 19 aa, Plasmodium falciparum
IIYAWSIKEGFIKSRISCL

SEQ ID NO: 3384470 - protein, 18 aa, Plasmodium falciparum
IIYDCSCIYMTFSNSKLE

SEQ ID NO: 3384471 - protein, 20 aa, Plasmodium falciparum
IIYEIMHCLIKLDKKKKQKK

SEQ ID NO: 3384472 - protein, 22 aa, Plasmodium falciparum
IIYFNMNLFLIEAYGYGDIFNI

SEQ ID NO: 3384473 - protein, 22 aa, Plasmodium falciparum
IIYKENITFLTYFYSCINIIKE

SEQ ID NO: 3384474 - protein, 17 aa, Plasmodium falciparum
IIYKSLKYVPSLFDCTF

SEQ ID NO: 3384475 - protein, 26 aa, Plasmodium falciparum
IKCICPSRNFFGMRSYLRDISKGTSI

SEQ ID NO: 3384476 - protein, 34 aa, Plasmodium falciparum
IKCIKPQYDYILEYFLKKYFNSFLLIQKDNKELL

SEQ ID NO: 3384477 - protein, 18 aa, Plasmodium falciparum
IKCPICQGILKYGILNKK

SEQ ID NO: 3384478 - protein, 20 aa, Plasmodium falciparum
IKCSWLCQRKYLKNVKDLLK

SEQ ID NO: 3384479 - protein, 22 aa, Plasmodium falciparum
IKDEHAFYGSFLNKEKMNNKIK

SEQ ID NO: 3384480 - protein, 18 aa, Plasmodium falciparum
IKDFKFALVWGRSTKHNP

SEQ ID NO: 3384481 - protein, 22 aa, Plasmodium falciparum
IKDFNFFVNFLKQNIYSHTYCF

SEQ ID NO: 3384482 - protein, 27 aa, Plasmodium falciparum
IKDGYKYLFFFQDTNALALKVLFVCLG

SEQ ID NO: 3384483 - protein, 18 aa, Plasmodium falciparum
IKDIFLYGVNLNVDIFIL

SEQ ID NO: 3384484 - protein, 20 aa, Plasmodium falciparum
IKDILLTEPPLCSISHRKKM

SEQ ID NO: 3384485 - protein, 21 aa, Plasmodium falciparum
IKDIYTYWKNKRKKLGRPLLR

SEQ ID NO: 3384486 - protein, 30 aa, Plasmodium falciparum
IKDKVTNNSLQYGFIEFEKKEDCLNAYFEM

SEQ ID NO: 3384487 - protein, 29 aa, Plasmodium falciparum
IKDNFIITEKIINSLLYSDPFMNINSYYY

SEQ ID NO: 3384488 - protein, 23 aa, Plasmodium falciparum
IKDNYILNRLSVFQVLKLLSSIV

SEQ ID NO: 3384489 - protein, 27 aa, Plasmodium falciparum
IKDSNKLFTILFTILNVGNTLNYGDAQ

SEQ ID NO: 3384490 - protein, 27 aa, Plasmodium falciparum
IKDVAPLLYYFTYFNLYSSFYFEKQMS

SEQ ID NO: 3384491 - protein, 33 aa, Plasmodium falciparum
IKEDRKYCFNLLYEEQPYKALLLKNDMGINSSE

SEQ ID NO: 3384492 - protein, 23 aa, Plasmodium falciparum
IKEDTHFVLYKKNSLIKEQDIYT

SEQ ID NO: 3384493 - protein, 17 aa, Plasmodium falciparum
IKEEHIKEWIPINKLYI

SEQ ID NO: 3384494 - protein, 27 aa, Plasmodium falciparum
IKEENTFIYFCRCGDFFIFNENLCYEY

SEQ ID NO: 3384495 - protein, 18 aa, Plasmodium falciparum
IKEFINFLKLNFPEENLE

SEQ ID NO: 3384496 - protein, 19 aa, Plasmodium falciparum
IKEFYYLNETDKKPFPICL

SEQ ID NO: 3384497 - protein, 24 aa, Plasmodium falciparum
IKEIELQFLIIQNVTHENKGIPIS

SEQ ID NO: 3384498 - protein, 23 aa, Plasmodium falciparum
IKEKHKYYKFIKGKKYTSSIKSR

SEQ ID NO: 3384499 - protein, 28 aa, Plasmodium falciparum
IKEKRILIWLTQILTALKFLHSNHILHR

SEQ ID NO: 3384500 - protein, 17 aa, Plasmodium falciparum
IKESLEYGELLLSNVKE

SEQ ID NO: 3384501 - protein, 22 aa, Plasmodium falciparum
IKEYQIIDYFFQPNECSHPLKD

SEQ ID NO: 3384502 - protein, 25 aa, Plasmodium falciparum
IKFDKKQFFFFPSNIKKKKMNKKYH

SEQ ID NO: 3384503 - protein, 23 aa, Plasmodium falciparum
IKFKDFLFYKYECYITEGVIKEI

SEQ ID NO: 3384504 - protein, 21 aa, Plasmodium falciparum
IKFLLVLDRIRYAYNLGKILN

SEQ ID NO: 3384505 - protein, 24 aa, Plasmodium falciparum
IKGKLYLHIHKLFINKLMTSNIRK

SEQ ID NO: 3384506 - protein, 29 aa, Plasmodium falciparum
IKGKSKELNLLIKNLLNLSAKERPSALQC

SEQ ID NO: 3384507 - protein, 17 aa, Plasmodium falciparum
IKGKSKTFLLISFTPNE

SEQ ID NO: 3384508 - protein, 24 aa, Plasmodium falciparum
IKGNHINFFSINKILNKTSMNDNL

SEQ ID NO: 3384509 - protein, 41 aa, Plasmodium falciparum
IKGNTIYSFLDIDLLPTPLLFYLYDNFKILQTLICKNSKEL

SEQ ID NO: 3384510 - protein, 25 aa, Plasmodium falciparum
IKGRLIVDIYLLCKDSIKLTTYCLD

SEQ ID NO: 3384511 - protein, 21 aa, Plasmodium falciparum
IKGTPIKIYYKQKKLRKIINK

SEQ ID NO: 3384512 - protein, 18 aa, Plasmodium falciparum
IKHFENCNHFAKCNKILA

SEQ ID NO: 3384513 - protein, 17 aa, Plasmodium falciparum
IKHFFDYNKYRSKCNVT

SEQ ID NO: 3384514 - protein, 24 aa, Plasmodium falciparum
IKHFNMFQLLLIIKGLYESRMLIN

SEQ ID NO: 3384515 - protein, 33 aa, Plasmodium falciparum
IKHKIKKRTLLPKYIFDKITFFEFENGQRIWRS

SEQ ID NO: 3384516 - protein, 19 aa, Plasmodium falciparum
IKHNQFIHLIIYDGFNKKI

SEQ ID NO: 3384517 - protein, 23 aa, Plasmodium falciparum
IKHRSFHNIYKQINIINDQIDLI

SEQ ID NO: 3384518 - protein, 20 aa, Plasmodium falciparum
IKICHNISLCYYFLEDFEKS

SEQ ID NO: 3384519 - protein, 21 aa, Plasmodium falciparum
IKIDRICEYLNYTTNTMWRYM

SEQ ID NO: 3384520 - protein, 20 aa, Plasmodium falciparum
IKIEDFLFNEYLKKVSVRSQ

SEQ ID NO: 3384521 - protein, 17 aa, Plasmodium falciparum
IKIILMSATFDINIFNQ

SEQ ID NO: 3384522 - protein, 28 aa, Plasmodium falciparum
IKIKFKSMICMNNFLKAYKNTPDKWKED

SEQ ID NO: 3384523 - protein, 17 aa, Plasmodium falciparum
IKIKRLCEKIEGFEKEI

SEQ ID NO: 3384524 - protein, 37 aa, Plasmodium falciparum
IKINIHKQFLHVTDFLYHLILHIYTKFTEKNNKLKFL

SEQ ID NO: 3384525 - protein, 28 aa, Plasmodium falciparum
IKIQIINQDILPFKNLEKPLIPLSSIKN

SEQ ID NO: 3384526 - protein, 17 aa, Plasmodium falciparum
IKIQRAFKKYMKKKYIL

SEQ ID NO: 3384527 - protein, 27 aa, Plasmodium falciparum
IKKATILRIFFWVIGQYMFNEHMIINF

SEQ ID NO: 3384528 - protein, 18 aa, Plasmodium falciparum
IKKDIYLLNIRDSQNKRD

SEQ ID NO: 3384529 - protein, 23 aa, Plasmodium falciparum
IKKELLIIVQKMQNLYVKREELK

SEQ ID NO: 3384530 - protein, 26 aa, Plasmodium falciparum
IKKHPFFKNINWNDVLYKKVKPPFKP

SEQ ID NO: 3384531 - protein, 17 aa, Plasmodium falciparum
IKKIFYTFICESKYQLL

SEQ ID NO: 3384532 - protein, 31 aa, Plasmodium falciparum
IKKIYGSLYKVKKKKKIYFKLGHKKKNKKNN

SEQ ID NO: 3384533 - protein, 19 aa, Plasmodium falciparum
IKKKIICDKIKGIEKLKEP

SEQ ID NO: 3384534 - protein, 24 aa, Plasmodium falciparum
IKKKIKNFKPHKIQFFITIKSNNT

SEQ ID NO: 3384535 - protein, 25 aa, Plasmodium falciparum
IKKKKFIRFTLIKSQKNIKYLYSYS

SEQ ID NO: 3384536 - protein, 24 aa, Plasmodium falciparum
IKKKKIIIRKLPPTLTEENFFDSF

SEQ ID NO: 3384537 - protein, 23 aa, Plasmodium falciparum
IKKKKKKFLFKKKQLMNDTDENS

SEQ ID NO: 3384538 - protein, 30 aa, Plasmodium falciparum
IKKKKKKIRFPIRRIPPNEYYPNIHSIKFL

SEQ ID NO: 3384539 - protein, 27 aa, Plasmodium falciparum
IKKKKNGFIYLVKWKGYSDDENTWEPE

SEQ ID NO: 3384540 - protein, 17 aa, Plasmodium falciparum
IKKKRIKMRNHEKKRKI

SEQ ID NO: 3384541 - protein, 24 aa, Plasmodium falciparum
IKKKTLFLFGTYNLGKEKIYLSLS

SEQ ID NO: 3384542 - protein, 25 aa, Plasmodium falciparum
IKKLESLGFPKHVALEAFIACDKNE

SEQ ID NO: 3384543 - protein, 33 aa, Plasmodium falciparum
IKKMFIIEGGGDFLLFLNIYKQCEENNFSTSFC

SEQ ID NO: 3384544 - protein, 21 aa, Plasmodium falciparum
IKKNFLLNLSKENIFHKGNIG

SEQ ID NO: 3384545 - protein, 31 aa, Plasmodium falciparum
IKKNIIKLEKTFLDNVLLQVKKKNIAGNKNT

SEQ ID NO: 3384546 - protein, 28 aa, Plasmodium falciparum
IKKNLPDIIFIQFLNRILYKLDKTILKY

SEQ ID NO: 3384547 - protein, 29 aa, Plasmodium falciparum
IKKNMWTHKFHYIYPYVHFMGTKHKQNNK

SEQ ID NO: 3384548 - protein, 28 aa, Plasmodium falciparum
IKKRISFTGFYLQNLFAYSIANSVNADI

SEQ ID NO: 3384549 - protein, 17 aa, Plasmodium falciparum
IKKRKTIKQIKNLQWEK

SEQ ID NO: 3384550 - protein, 29 aa, Plasmodium falciparum
IKKSIVMLEVLRVLLCVLYYTQNVEGVTN

SEQ ID NO: 3384551 - protein, 22 aa, Plasmodium falciparum
IKKSIVSAFFTNAALPVNKTEL

SEQ ID NO: 3384552 - protein, 23 aa, Plasmodium falciparum
IKKTLHDLIFILKKFLENNMNKK

SEQ ID NO: 3384553 - protein, 19 aa, Plasmodium falciparum
IKKVIFIKTFMKALNILNE

SEQ ID NO: 3384554 - protein, 23 aa, Plasmodium falciparum
IKKVKVIPGKWEGNGLLGIHISY

SEQ ID NO: 3384555 - protein, 19 aa, Plasmodium falciparum
IKKYFIFERYNDKITIDMI

SEQ ID NO: 3384556 - protein, 27 aa, Plasmodium falciparum
IKLASECVFNFLLNYNKSNLHDLSNIG

SEQ ID NO: 3384557 - protein, 30 aa, Plasmodium falciparum
IKLDCPLCYDIFLKYLRFSILDNIIDKNYI

SEQ ID NO: 3384558 - protein, 24 aa, Plasmodium falciparum
IKLDHRSICLFSEKFNLIQTNDKL

SEQ ID NO: 3384559 - protein, 30 aa, Plasmodium falciparum
IKLEDIDLPPFYFDLIINPIPSYKIRKFNK

SEQ ID NO: 3384560 - protein, 26 aa, Plasmodium falciparum
IKLESRNMIYEYYKNLDVNECTVHII

SEQ ID NO: 3384561 - protein, 20 aa, Plasmodium falciparum
IKLNNKPSLKWRLINKESNF

SEQ ID NO: 3384562 - protein, 17 aa, Plasmodium falciparum
IKLVKKKEKLSKKGILK

SEQ ID NO: 3384563 - protein, 24 aa, Plasmodium falciparum
IKLVNIGHKLNTLMRSHYERIYDC

SEQ ID NO: 3384564 - protein, 20 aa, Plasmodium falciparum
IKLWDVKYRYIIQTYRGHKQ

SEQ ID NO: 3384565 - protein, 20 aa, Plasmodium falciparum
IKLYDYLSFINFVTFTAHTN

SEQ ID NO: 3384566 - protein, 24 aa, Plasmodium falciparum
IKNDIFGNLVFLDGSYKNMTNKMN

SEQ ID NO: 3384567 - protein, 21 aa, Plasmodium falciparum
IKNDKLLWDINTDDFHIFNLQ

SEQ ID NO: 3384568 - protein, 24 aa, Plasmodium falciparum
IKNESEFEYLLELSDKEGPNLDNP

SEQ ID NO: 3384569 - protein, 25 aa, Plasmodium falciparum
IKNFKDMKFPKAILKGLRKKNIKKP

SEQ ID NO: 3384570 - protein, 19 aa, Plasmodium falciparum
IKNFKNEYYWSIKMKYVYN

SEQ ID NO: 3384571 - protein, 28 aa, Plasmodium falciparum
IKNGKKQIFFLFPLKSLINEKMTYLKNI

SEQ ID NO: 3384572 - protein, 20 aa, Plasmodium falciparum
IKNHHTYYLKNSFLNEIGAC

SEQ ID NO: 3384573 - protein, 35 aa, Plasmodium falciparum
IKNIKNPLIVFDSFEDYIMDIKWSPTHPALFSTCS

SEQ ID NO: 3384574 - protein, 31 aa, Plasmodium falciparum
IKNIKTQVSDLLLLMQQYAIIYHNIKFVIYN

SEQ ID NO: 3384575 - protein, 19 aa, Plasmodium falciparum
IKNISEIISFLSYIKEHSL

SEQ ID NO: 3384576 - protein, 23 aa, Plasmodium falciparum
IKNIWKDDFFITSLPLSAHSIIS

SEQ ID NO: 3384577 - protein, 33 aa, Plasmodium falciparum
IKNKEKYQSLLQQFIIILKHHDNLYLQKREKLI

SEQ ID NO: 3384578 - protein, 26 aa, Plasmodium falciparum
IKNKGTINYSFKYPPKSNLKNNMKSN

SEQ ID NO: 3384579 - protein, 18 aa, Plasmodium falciparum
IKNKMYDYFDYEKNNMIH

SEQ ID NO: 3384580 - protein, 25 aa, Plasmodium falciparum
IKNKNDNILRHLNVRRKRIVQSSDE

SEQ ID NO: 3384581 - protein, 22 aa, Plasmodium falciparum
IKNKNIYLYKISNDNLKTCSNY

SEQ ID NO: 3384582 - protein, 27 aa, Plasmodium falciparum
IKNKYIHLLNMNLNFVQLLLKITNAFN

SEQ ID NO: 3384583 - protein, 23 aa, Plasmodium falciparum
IKNLLFINQYTNLILKNLYIENL

SEQ ID NO: 3384584 - protein, 24 aa, Plasmodium falciparum
IKNLYILPMTTIKMNISTGIVPCV

SEQ ID NO: 3384585 - protein, 17 aa, Plasmodium falciparum
IKNLYKAKNLRILCLSN

SEQ ID NO: 3384586 - protein, 24 aa, Plasmodium falciparum
IKNMLKKAEDILYTNRINNLYNNN

SEQ ID NO: 3384587 - protein, 18 aa, Plasmodium falciparum
IKNNSMPYSIRKNKLSYN

SEQ ID NO: 3384588 - protein, 17 aa, Plasmodium falciparum
IKNRSSTRITNAPGGNS

SEQ ID NO: 3384589 - protein, 33 aa, Plasmodium falciparum
IKNTLRIRNNTKHIFIYLITHTNIVKHKNKTFS

SEQ ID NO: 3384590 - protein, 29 aa, Plasmodium falciparum
IKNVEKNFLLYYTYIFFNYDKNDLNNNNS

SEQ ID NO: 3384591 - protein, 17 aa, Plasmodium falciparum
IKNVFSNDIIRYRDKDH

SEQ ID NO: 3384592 - protein, 24 aa, Plasmodium falciparum
IKNVKSFCLAFYYALNKKHAEAHV

SEQ ID NO: 3384593 - protein, 26 aa, Plasmodium falciparum
IKNYFTYEILLQRKIKTLLLPNVSLI

SEQ ID NO: 3384594 - protein, 22 aa, Plasmodium falciparum
IKNYKKRLLKIEKNITLLDIYK

SEQ ID NO: 3384595 - protein, 17 aa, Plasmodium falciparum
IKNYSWIVKEVIAIIIL

SEQ ID NO: 3384596 - protein, 18 aa, Plasmodium falciparum
IKNYVYLDAMFFGMSMCC

SEQ ID NO: 3384597 - protein, 30 aa, Plasmodium falciparum
IKPKRHYDLLCRILFIYAKIHPYVKYVQGM

SEQ ID NO: 3384598 - protein, 26 aa, Plasmodium falciparum
IKPKYEKYFYNFIKNVSLNDNKNMYD

SEQ ID NO: 3384599 - protein, 26 aa, Plasmodium falciparum
IKPLCICCFDILLNLIGINTIICISC

SEQ ID NO: 3384600 - protein, 25 aa, Plasmodium falciparum
IKPLIIDLYENGCVCSCFAYGQTGS

SEQ ID NO: 3384601 - protein, 36 aa, Plasmodium falciparum
IKPYIKELRNISSGKRIAWKLAKKHPLLNADINNQY

SEQ ID NO: 3384602 - protein, 25 aa, Plasmodium falciparum
IKQKSYIDLINFSKGLYLCLSNTSP

SEQ ID NO: 3384603 - protein, 30 aa, Plasmodium falciparum
IKQLEEVLHKHFILLKNLRKKNLSLNLNNL

SEQ ID NO: 3384604 - protein, 29 aa, Plasmodium falciparum
IKQNEELVQLVKIPNLKTPLIVLDNIIGQ

SEQ ID NO: 3384605 - protein, 19 aa, Plasmodium falciparum
IKRENILGFLIDNINVDKT

SEQ ID NO: 3384606 - protein, 23 aa, Plasmodium falciparum
IKRIPINLKYFLSTDKWGFNIWS

SEQ ID NO: 3384607 - protein, 26 aa, Plasmodium falciparum
IKRKKINDIINKYKKKMIIPSYEEND

SEQ ID NO: 3384608 - protein, 24 aa, Plasmodium falciparum
IKRKKYLSVFILLSKLSPSIINDT

SEQ ID NO: 3384609 - protein, 35 aa, Plasmodium falciparum
IKRKPNDFLYLLVKYKHLNKWMFPIMDFKKNYSIR

SEQ ID NO: 3384610 - protein, 25 aa, Plasmodium falciparum
IKRNKGFAFITFKNSNDATSSLILN

SEQ ID NO: 3384611 - protein, 26 aa, Plasmodium falciparum
IKRPNNNLFFEVIRGKKRKNMQGFEC

SEQ ID NO: 3384612 - protein, 21 aa, Plasmodium falciparum
IKRQRVLRRLLKRLRDSKKVD

SEQ ID NO: 3384613 - protein, 31 aa, Plasmodium falciparum
IKRTPFCIYSLNDICNHLRYGKKSANSINGM

SEQ ID NO: 3384614 - protein, 21 aa, Plasmodium falciparum
IKSEFLSFLIEEMKYDILNSK

SEQ ID NO: 3384615 - protein, 26 aa, Plasmodium falciparum
IKSEKRIRKYRTKKMLLKEAMEKGIS

SEQ ID NO: 3384616 - protein, 25 aa, Plasmodium falciparum
IKSELECFITSFNNLKKLKMKNEEI

SEQ ID NO: 3384617 - protein, 30 aa, Plasmodium falciparum
IKSFEIDLTHIFFFNKKLYKLIIEYPSDCI

SEQ ID NO: 3384618 - protein, 34 aa, Plasmodium falciparum
IKSFFNSLFSKRFGISILGIIYNGFSSNKYLLSN

SEQ ID NO: 3384619 - protein, 29 aa, Plasmodium falciparum
IKSKKLSIYFYWFLLSEAKDKIKGKLYLH

SEQ ID NO: 3384620 - protein, 17 aa, Plasmodium falciparum
IKSLYSFTPLQLTNVIY

SEQ ID NO: 3384621 - protein, 25 aa, Plasmodium falciparum
IKSSNKIIGLYNYSRYYGLREDLCK

SEQ ID NO: 3384622 - protein, 26 aa, Plasmodium falciparum
IKSSNLKTFIDHLNFFQSKCKANKGF

SEQ ID NO: 3384623 - protein, 28 aa, Plasmodium falciparum
IKSTQNYSPLFHRSIHKFELKKNLSNIR

SEQ ID NO: 3384624 - protein, 29 aa, Plasmodium falciparum
IKSYLTSFLARIFTIFSISKIYIYDDYLE

SEQ ID NO: 3384625 - protein, 18 aa, Plasmodium falciparum
IKSYNPYFNYIQTNDKIS

SEQ ID NO: 3384626 - protein, 22 aa, Plasmodium falciparum
IKTCDYTYSFLPTLDQDYSSIL

SEQ ID NO: 3384627 - protein, 22 aa, Plasmodium falciparum
IKTFYFEEFDFNFVLLGSVKKG

SEQ ID NO: 3384628 - protein, 19 aa, Plasmodium falciparum
IKTGYFYFRSGVPVITPHI

SEQ ID NO: 3384629 - protein, 23 aa, Plasmodium falciparum
IKTPLLIFATGFKKDNFSLNFYN

SEQ ID NO: 3384630 - protein, 23 aa, Plasmodium falciparum
IKTVKIIYDKNLKPRGYAFIEFE

SEQ ID NO: 3384631 - protein, 20 aa, Plasmodium falciparum
IKYAWRIIYDLLKGSSHMKK

SEQ ID NO: 3384632 - protein, 17 aa, Plasmodium falciparum
IKYCLKLAFYNIYNEIY

SEQ ID NO: 3384633 - protein, 26 aa, Plasmodium falciparum
IKYCRNLWYYNYFSRDININNYAFKK

SEQ ID NO: 3384634 - protein, 23 aa, Plasmodium falciparum
IKYDLEGFFPTSNQYRELVSCSN

SEQ ID NO: 3384635 - protein, 34 aa, Plasmodium falciparum
IKYHEACENFSILFKIFYDSLIYIVKKNEEADHV

SEQ ID NO: 3384636 - protein, 18 aa, Plasmodium falciparum
IKYKFLEDCIYLLKEERG

SEQ ID NO: 3384637 - protein, 20 aa, Plasmodium falciparum
IKYKTPRALNPKHSKVMKLL

SEQ ID NO: 3384638 - protein, 17 aa, Plasmodium falciparum
IKYLLLYDNFCTNNNKI

SEQ ID NO: 3384639 - protein, 25 aa, Plasmodium falciparum
IKYLRNLPCWNLLKLNPIHPNNIHH

SEQ ID NO: 3384640 - protein, 19 aa, Plasmodium falciparum
ILCDNKNLIFYYGHKKSVT

SEQ ID NO: 3384641 - protein, 31 aa, Plasmodium falciparum
ILCKQFIKFTVPCYHIFLKRNQINSIRQKQS

SEQ ID NO: 3384642 - protein, 30 aa, Plasmodium falciparum
ILCTFRQDFINYVIFLFSKRLHKENQIEPV

SEQ ID NO: 3384643 - protein, 30 aa, Plasmodium falciparum
ILDDFCYMTYIIKTLYFRFQSRSIRNMLKS

SEQ ID NO: 3384644 - protein, 30 aa, Plasmodium falciparum
ILDEEKIQLHNYMDYLYDIKNNNVDSSEIL

SEQ ID NO: 3384645 - protein, 17 aa, Plasmodium falciparum
ILDIGCGNGLFLYKLYE

SEQ ID NO: 3384646 - protein, 26 aa, Plasmodium falciparum
ILDIHNRLPIHSACLGGVLENVKILV

SEQ ID NO: 3384647 - protein, 34 aa, Plasmodium falciparum
ILDILCTEAIRKIKFILHILNELLKKKKNILHVY

SEQ ID NO: 3384648 - protein, 18 aa, Plasmodium falciparum
ILDIPLKESIERTKKFID

SEQ ID NO: 3384649 - protein, 17 aa, Plasmodium falciparum
ILDIYKQGNMYMHIPKN

SEQ ID NO: 3384650 - protein, 41 aa, Plasmodium falciparum
ILDKGEIYLYMKSVERAHLPSALWSRVLLSLNKKEAFNVIY

SEQ ID NO: 3384651 - protein, 17 aa, Plasmodium falciparum
ILDKINQMHYIHSNKKK

SEQ ID NO: 3384652 - protein, 27 aa, Plasmodium falciparum
ILDNTYKYIIYFIDKKIYDNAIKSIND

SEQ ID NO: 3384653 - protein, 26 aa, Plasmodium falciparum
ILDRSTKRVSILDKLNLGLKNKGNDK

SEQ ID NO: 3384654 - protein, 18 aa, Plasmodium falciparum
ILDTNISIIINKLKNDYI

SEQ ID NO: 3384655 - protein, 22 aa, Plasmodium falciparum
ILEELLEILGLYISNVPCLIIS

SEQ ID NO: 3384656 - protein, 20 aa, Plasmodium falciparum
ILEFVIYQSGVDLGLEFTLK

SEQ ID NO: 3384657 - protein, 26 aa, Plasmodium falciparum
ILEGDYCEYFYFIKQGQISIQKFNQH

SEQ ID NO: 3384658 - protein, 27 aa, Plasmodium falciparum
ILEHMYYKPEMLFKQIWTYLMNGKEML

SEQ ID NO: 3384659 - protein, 19 aa, Plasmodium falciparum
ILEKFGLSYKKSEKTSLGC

SEQ ID NO: 3384660 - protein, 23 aa, Plasmodium falciparum
ILEKHFIFDIKIPRAVYAYKTNR

SEQ ID NO: 3384661 - protein, 19 aa, Plasmodium falciparum
ILEKLLIHIQKLDKKENLT

SEQ ID NO: 3384662 - protein, 23 aa, Plasmodium falciparum
ILENGYFLTFKKHVSVLANELRS

SEQ ID NO: 3384663 - protein, 26 aa, Plasmodium falciparum
ILENINKYIIMPEFVIILKSTEELCK

SEQ ID NO: 3384664 - protein, 24 aa, Plasmodium falciparum
ILERLFVIYLCVLKEYEKHPPKIL

SEQ ID NO: 3384665 - protein, 24 aa, Plasmodium falciparum
ILEVVDFMSLLHHLTEHPVASYNE

SEQ ID NO: 3384666 - protein, 19 aa, Plasmodium falciparum
ILGDIPDADMKPPENILFV

SEQ ID NO: 3384667 - protein, 20 aa, Plasmodium falciparum
ILGGIIITPTRELVFQIFEV

SEQ ID NO: 3384668 - protein, 20 aa, Plasmodium falciparum
ILGIPLCHIMKIKKKNKNVA

SEQ ID NO: 3384669 - protein, 22 aa, Plasmodium falciparum
ILGSEKALFRALKTKSKTPKYG

SEQ ID NO: 3384670 - protein, 29 aa, Plasmodium falciparum
ILHEIQVRWKSLTKMWYKKNKNKYDTSKI

SEQ ID NO: 3384671 - protein, 27 aa, Plasmodium falciparum
ILHLTFTPRKIVPLPFPSLFYDHDSSL

SEQ ID NO: 3384672 - protein, 19 aa, Plasmodium falciparum
ILHTNILENYNFNWNKKKD

SEQ ID NO: 3384673 - protein, 20 aa, Plasmodium falciparum
ILIEHFYKNKNLYNNTWESL

SEQ ID NO: 3384674 - protein, 21 aa, Plasmodium falciparum
ILIGLKYLFDNIDEINFLILN

SEQ ID NO: 3384675 - protein, 18 aa, Plasmodium falciparum
ILIHFIQNNIILTNSMDT

SEQ ID NO: 3384676 - protein, 17 aa, Plasmodium falciparum
ILIINCIDKLIMDLRLP

SEQ ID NO: 3384677 - protein, 30 aa, Plasmodium falciparum
ILIITSILNIMKWKSLFFTFSNITIYKNEE

SEQ ID NO: 3384678 - protein, 18 aa, Plasmodium falciparum
ILIKNIPKLVPNWKKPIV

SEQ ID NO: 3384679 - protein, 17 aa, Plasmodium falciparum
ILINKLCKKKSFSGLKL

SEQ ID NO: 3384680 - protein, 18 aa, Plasmodium falciparum
ILISSVFGRIKWLKIMNE

SEQ ID NO: 3384681 - protein, 25 aa, Plasmodium falciparum
ILKEFKKYMNLIIQDGYTCAYYKDK

SEQ ID NO: 3384682 - protein, 26 aa, Plasmodium falciparum
ILKEKKSHIILLKEDLHFLNDEYDNI

SEQ ID NO: 3384683 - protein, 17 aa, Plasmodium falciparum
ILKGYDIILLRYSYEVI

SEQ ID NO: 3384684 - protein, 19 aa, Plasmodium falciparum
ILKILHLHNSVLYTYPSLN

SEQ ID NO: 3384685 - protein, 17 aa, Plasmodium falciparum
ILKKFENIIFYGNTQSD

SEQ ID NO: 3384686 - protein, 27 aa, Plasmodium falciparum
ILKKHKDLVFFLKKQQLLKLILNNNIN

SEQ ID NO: 3384687 - protein, 20 aa, Plasmodium falciparum
ILKKLYEHIFNKKIYELINV

SEQ ID NO: 3384688 - protein, 25 aa, Plasmodium falciparum
ILKLDNFLDMILNYSYYLLNDSCNK

SEQ ID NO: 3384689 - protein, 18 aa, Plasmodium falciparum
ILKLKKIATLLKKEYNKL

SEQ ID NO: 3384690 - protein, 17 aa, Plasmodium falciparum
ILKLLKVSNNKLIQNLY

SEQ ID NO: 3384691 - protein, 18 aa, Plasmodium falciparum
ILKLMYNNNGIYFDDDDE

SEQ ID NO: 3384692 - protein, 17 aa, Plasmodium falciparum
ILKMIIKYENFNSIMNQ

SEQ ID NO: 3384693 - protein, 20 aa, Plasmodium falciparum
ILKNILYLENVIEKYNIHMS

SEQ ID NO: 3384694 - protein, 19 aa, Plasmodium falciparum
ILKNIPRYNNMSSNYLLNL

SEQ ID NO: 3384695 - protein, 25 aa, Plasmodium falciparum
ILKNRKYLDILLNIINIFIDKYENK

SEQ ID NO: 3384696 - protein, 24 aa, Plasmodium falciparum
ILKPHLWNLPWRKYYENKINKIYK

SEQ ID NO: 3384697 - protein, 32 aa, Plasmodium falciparum
ILKQEFANIEECFKIHTSSINYMKVKGKGECC

SEQ ID NO: 3384698 - protein, 46 aa, Plasmodium falciparum
ILKSKRFLNVALFYDLIYNFLYKNNIFLKYFFSFSGGRFIKTFIDY

SEQ ID NO: 3384699 - protein, 24 aa, Plasmodium falciparum
ILKTNLIMMKILYNIYYAYFSSSF

SEQ ID NO: 3384700 - protein, 25 aa, Plasmodium falciparum
ILLSVICVSLTKLYLKLLSKMNNSF

SEQ ID NO: 3384701 - protein, 17 aa, Plasmodium falciparum
ILLSYFGMEFNGSAYQK

SEQ ID NO: 3384702 - protein, 21 aa, Plasmodium falciparum
ILLTMIRICIFYNDVKNLKKY

SEQ ID NO: 3384703 - protein, 36 aa, Plasmodium falciparum
ILMNPNFHIFSTYKGNILFFDLRCMLPIYQNNNLHS

SEQ ID NO: 3384704 - protein, 21 aa, Plasmodium falciparum
ILNDIYMPYRILLSKDKNYVS

SEQ ID NO: 3384705 - protein, 17 aa, Plasmodium falciparum
ILNIRKMNISTLCNILY

SEQ ID NO: 3384706 - protein, 18 aa, Plasmodium falciparum
ILNISKLPKCDILKRTNR

SEQ ID NO: 3384707 - protein, 20 aa, Plasmodium falciparum
ILNKINVNKIYYHKMNHPDE

SEQ ID NO: 3384708 - protein, 29 aa, Plasmodium falciparum
ILNKKNFFLILNYLLYIFNHNLNLLMKDK

SEQ ID NO: 3384709 - protein, 35 aa, Plasmodium falciparum
ILNLTQEEFIYISNKIHFLGFRFIEIPCVKTKNEK

SEQ ID NO: 3384710 - protein, 17 aa, Plasmodium falciparum
ILNLYKIKKTNKAIILV

SEQ ID NO: 3384711 - protein, 21 aa, Plasmodium falciparum
ILNNIFIYAPVDLFALHIHYY

SEQ ID NO: 3384712 - protein, 33 aa, Plasmodium falciparum
ILNNSQMLEAFIQGRLCLSCDSLDHPMPLCPNN

SEQ ID NO: 3384713 - protein, 20 aa, Plasmodium falciparum
ILPDHAYPKWLWKLEKPLKS

SEQ ID NO: 3384714 - protein, 29 aa, Plasmodium falciparum
ILPENKEYVIKLFFGNLAPITTEKDMHNL

SEQ ID NO: 3384715 - protein, 23 aa, Plasmodium falciparum
ILPGEFFNEKINECLNLLDKIAQ

SEQ ID NO: 3384716 - protein, 27 aa, Plasmodium falciparum
ILPIDITAHLLIPLPGGQQGPSGVLIC

SEQ ID NO: 3384717 - protein, 17 aa, Plasmodium falciparum
ILPQKKWNVYRKDAQYK

SEQ ID NO: 3384718 - protein, 22 aa, Plasmodium falciparum
ILPSRLFGHLILTTPYGIMDHE

SEQ ID NO: 3384719 - protein, 22 aa, Plasmodium falciparum
ILPTVLNYVLLPTIDMIKNDFS

SEQ ID NO: 3384720 - protein, 18 aa, Plasmodium falciparum
ILQFLKKSNTISLMEHFR

SEQ ID NO: 3384721 - protein, 24 aa, Plasmodium falciparum
ILQIRKLFKYKRINILLVTGRLIY

SEQ ID NO: 3384722 - protein, 23 aa, Plasmodium falciparum
ILQKYKGIFCNYEYYFDLEVKYN

SEQ ID NO: 3384723 - protein, 20 aa, Plasmodium falciparum
ILQNIIMQKKMKYAFDVTSI

SEQ ID NO: 3384724 - protein, 18 aa, Plasmodium falciparum
ILREAGLKPDFIFCRCEE

SEQ ID NO: 3384725 - protein, 26 aa, Plasmodium falciparum
ILREENIFFFHIIPEQTHNGLYLGCH

SEQ ID NO: 3384726 - protein, 19 aa, Plasmodium falciparum
ILREHFWHIKYIKNMTWND

SEQ ID NO: 3384727 - protein, 27 aa, Plasmodium falciparum
ILRKMNALLFFIKILCKNIILKKGSEL

SEQ ID NO: 3384728 - protein, 17 aa, Plasmodium falciparum
ILRNLLYLNDNIINNIH

SEQ ID NO: 3384729 - protein, 37 aa, Plasmodium falciparum
ILSKKRSIELGNILHNLIYGYIYKGDNVRLTIGKESK

SEQ ID NO: 3384730 - protein, 18 aa, Plasmodium falciparum
ILSLYIDPYNRYKSYNEY

SEQ ID NO: 3384731 - protein, 19 aa, Plasmodium falciparum
ILSPNILKLLKVSNNKLIQ

SEQ ID NO: 3384732 - protein, 17 aa, Plasmodium falciparum
ILSSIIHTYNIPSFFLL

SEQ ID NO: 3384733 - protein, 22 aa, Plasmodium falciparum
ILSWNPMNYFILSSTSFDSSVN

SEQ ID NO: 3384734 - protein, 23 aa, Plasmodium falciparum
ILTFMIFTILHKANTNFLVYNMA

SEQ ID NO: 3384735 - protein, 19 aa, Plasmodium falciparum
ILTIFGKKENKKKALELVL

SEQ ID NO: 3384736 - protein, 27 aa, Plasmodium falciparum
ILTKYPIDFFNKLLLKLYNIENNIYEI

SEQ ID NO: 3384737 - protein, 28 aa, Plasmodium falciparum
ILTNIKQLIIFIPTYIEYLRIHELLKKN

SEQ ID NO: 3384738 - protein, 35 aa, Plasmodium falciparum
ILTQEQWEYIEKIKNYLYATYLKEKDKEHNHILNS

SEQ ID NO: 3384739 - protein, 17 aa, Plasmodium falciparum
ILVILIYEYVKNRDINC

SEQ ID NO: 3384740 - protein, 19 aa, Plasmodium falciparum
ILVVFNEGYAPDGVWLGGT

SEQ ID NO: 3384741 - protein, 28 aa, Plasmodium falciparum
ILYDDKKVLFLFFISGNLQNFHVTSNNN

SEQ ID NO: 3384742 - protein, 23 aa, Plasmodium falciparum
ILYDYMINLPSWEYYDINRRLFL

SEQ ID NO: 3384743 - protein, 20 aa, Plasmodium falciparum
ILYKKNFLKTLKLMDRIYNK

SEQ ID NO: 3384744 - protein, 26 aa, Plasmodium falciparum
ILYKRDIFNICFIFQYMILTNEKKKV

SEQ ID NO: 3384745 - protein, 17 aa, Plasmodium falciparum
ILYLHKFNEDLGTIIPT

SEQ ID NO: 3384746 - protein, 18 aa, Plasmodium falciparum
ILYLLHEAFIECGQKKRI

SEQ ID NO: 3384747 - protein, 21 aa, Plasmodium falciparum
ILYLMNNPILLKYNNYRKLFI

SEQ ID NO: 3384748 - protein, 25 aa, Plasmodium falciparum
IMCDDQRIPKARFLGLYMPNCPEWN

SEQ ID NO: 3384749 - protein, 19 aa, Plasmodium falciparum
IMDEVRGRDIYIIHSTPAG

SEQ ID NO: 3384750 - protein, 18 aa, Plasmodium falciparum
IMDYNIYKRLALIKNDHN

SEQ ID NO: 3384751 - protein, 18 aa, Plasmodium falciparum
IMEKMFPQIVIPKNIIFD

SEQ ID NO: 3384752 - protein, 18 aa, Plasmodium falciparum
IMGTLKKYLNITHTKDLL

SEQ ID NO: 3384753 - protein, 22 aa, Plasmodium falciparum
IMKGFLKEPSVLNNPIYLNNNT

SEQ ID NO: 3384754 - protein, 28 aa, Plasmodium falciparum
IMKTGYMHKNLIISILKQFGDNLTEEES

SEQ ID NO: 3384755 - protein, 29 aa, Plasmodium falciparum
IMLDVRLRKALLYLFKYQHPTIIQKMSIC

SEQ ID NO: 3384756 - protein, 24 aa, Plasmodium falciparum
IMMHNNYQPFLYENQYNKHIHMMN

SEQ ID NO: 3384757 - protein, 30 aa, Plasmodium falciparum
IMNAQELIDIWKLLIKLINNFFPVQEKEKC

SEQ ID NO: 3384758 - protein, 18 aa, Plasmodium falciparum
IMNHLFHMKPHCNLKDKV

SEQ ID NO: 3384759 - protein, 25 aa, Plasmodium falciparum
IMNINSKFEPLPKIIISCDTIVTLN

SEQ ID NO: 3384760 - protein, 17 aa, Plasmodium falciparum
IMNIPKKGLGNEYYNYP

SEQ ID NO: 3384761 - protein, 29 aa, Plasmodium falciparum
IMNKSDPFFFLFLFNFIIKNIQNNKMMIT

SEQ ID NO: 3384762 - protein, 18 aa, Plasmodium falciparum
IMPNFFNYHEFCDRYCFK

SEQ ID NO: 3384763 - protein, 25 aa, Plasmodium falciparum
IMQRDIIYHLFDSFTAYLKKIEEEK

SEQ ID NO: 3384764 - protein, 18 aa, Plasmodium falciparum
IMRNKLKELLHKRNEYYL

SEQ ID NO: 3384765 - protein, 22 aa, Plasmodium falciparum
IMRRTIPNIYSFINLLSKLCES

SEQ ID NO: 3384766 - protein, 32 aa, Plasmodium falciparum
IMSLSKDSTFPFPPLTFIRNNTNKKRIASYNN

SEQ ID NO: 3384767 - protein, 18 aa, Plasmodium falciparum
IMTDLLSHYILRIAFSKD

SEQ ID NO: 3384768 - protein, 17 aa, Plasmodium falciparum
IMTLQMMVVIGELFRNI

SEQ ID NO: 3384769 - protein, 27 aa, Plasmodium falciparum
INAFIDICLLFHNYNYIKKLILIFNCI

SEQ ID NO: 3384770 - protein, 19 aa, Plasmodium falciparum
INALGPHPWALTFSYGRAL

SEQ ID NO: 3384771 - protein, 18 aa, Plasmodium falciparum
INALLEIGMYKENDMETL

SEQ ID NO: 3384772 - protein, 25 aa, Plasmodium falciparum
INAQFILNIIHSAEFFYFNSINQKT

SEQ ID NO: 3384773 - protein, 22 aa, Plasmodium falciparum
INARHRIFTEWSIEPTPLWTVE

SEQ ID NO: 3384774 - protein, 17 aa, Plasmodium falciparum
INARLETLHIKKSFSVL

SEQ ID NO: 3384775 - protein, 21 aa, Plasmodium falciparum
INCFLELELIFCEPSKSLWIN

SEQ ID NO: 3384776 - protein, 24 aa, Plasmodium falciparum
INCFSYYLLIQLCLFKSCLNSKVY

SEQ ID NO: 3384777 - protein, 20 aa, Plasmodium falciparum
INCSILIDWTKGFETGRATN

SEQ ID NO: 3384778 - protein, 28 aa, Plasmodium falciparum
INCSRNTLEFFLTKKYLKSSELIINEHD

SEQ ID NO: 3384779 - protein, 25 aa, Plasmodium falciparum
INDENGCYHLLTYPLEDEIENMNYY

SEQ ID NO: 3384780 - protein, 29 aa, Plasmodium falciparum
INDKRYLRYVFYYLKLLCTVKHISKHKIK

SEQ ID NO: 3384781 - protein, 27 aa, Plasmodium falciparum
INDLFRNFINCKINNLYVITTDTNKIP

SEQ ID NO: 3384782 - protein, 24 aa, Plasmodium falciparum
INDNFYIFLFYIINNKKTKHIDVN

SEQ ID NO: 3384783 - protein, 22 aa, Plasmodium falciparum
INDPIIIGDIKTKKLLFSDHNN

SEQ ID NO: 3384784 - protein, 23 aa, Plasmodium falciparum
INDQWLLICINQELKKIIKESGD

SEQ ID NO: 3384785 - protein, 35 aa, Plasmodium falciparum
INEAQKCILKIRKKKMTTFLNKIMSTPIHTKTTHW

SEQ ID NO: 3384786 - protein, 17 aa, Plasmodium falciparum
INEAYLYELTTLPDTLF

SEQ ID NO: 3384787 - protein, 26 aa, Plasmodium falciparum
INEIENYKIVLKNKGEMLLQNSSTMD

SEQ ID NO: 3384788 - protein, 23 aa, Plasmodium falciparum
INEILAPYLYNTSFICFIYSVGD

SEQ ID NO: 3384789 - protein, 17 aa, Plasmodium falciparum
INEINKLKLFIEENKMT

SEQ ID NO: 3384790 - protein, 26 aa, Plasmodium falciparum
INEIYNDRYRIEGKLGWGHFSTVWVA

SEQ ID NO: 3384791 - protein, 27 aa, Plasmodium falciparum
INEKFCAQNFLSLIQTFKNNIRKEKVL

SEQ ID NO: 3384792 - protein, 26 aa, Plasmodium falciparum
INEKSILQNILISKYVDMLNWTSEQV

SEQ ID NO: 3384793 - protein, 26 aa, Plasmodium falciparum
INEKSYQYHIYFKHKFLKEKNEINRK

SEQ ID NO: 3384794 - protein, 18 aa, Plasmodium falciparum
INEKYYFRHLSIYALQVK

SEQ ID NO: 3384795 - protein, 24 aa, Plasmodium falciparum
INELKIFIHKLNPIGTIYTTSYCY

SEQ ID NO: 3384796 - protein, 25 aa, Plasmodium falciparum
INENEFWLRYFSSIKMIIIKNFFET

SEQ ID NO: 3384797 - protein, 33 aa, Plasmodium falciparum
INENKTPFHFHWFKDDYIYFYKNKETEEYYICD

SEQ ID NO: 3384798 - protein, 25 aa, Plasmodium falciparum
INENPDFEFLFNTKVVKQENIGKDC

SEQ ID NO: 3384799 - protein, 19 aa, Plasmodium falciparum
INESLLICLKLDKKFKFKT

SEQ ID NO: 3384800 - protein, 17 aa, Plasmodium falciparum
INESYIPNYTNKSIRSV

SEQ ID NO: 3384801 - protein, 17 aa, Plasmodium falciparum
INEWLKNDIFFENILKS

SEQ ID NO: 3384802 - protein, 33 aa, Plasmodium falciparum
INFDKIEKNIMWKKLLIDMICFNNNLNVPYNES

SEQ ID NO: 3384803 - protein, 21 aa, Plasmodium falciparum
INFLDDQYLINIKSILILYNS

SEQ ID NO: 3384804 - protein, 18 aa, Plasmodium falciparum
INFLMSLKRAVLSELLII

SEQ ID NO: 3384805 - protein, 23 aa, Plasmodium falciparum
INGAIFILNPKTGQLFLKIIHTS

SEQ ID NO: 3384806 - protein, 23 aa, Plasmodium falciparum
INGKENIFAVEKVGINESGHMSN

SEQ ID NO: 3384807 - protein, 32 aa, Plasmodium falciparum
INGNYQHIIYQKNILSNFIAQIPSRIQVDDYV

SEQ ID NO: 3384808 - protein, 24 aa, Plasmodium falciparum
INHSNFDSSPFWLKNYKNISNYSN

SEQ ID NO: 3384809 - protein, 21 aa, Plasmodium falciparum
INICFICLRKFLNEEMLQRHI

SEQ ID NO: 3384810 - protein, 18 aa, Plasmodium falciparum
INIFLFRAVKKDINYIQE

SEQ ID NO: 3384811 - protein, 23 aa, Plasmodium falciparum
INIFNFKKFYNTDFSKENFTIIK

SEQ ID NO: 3384812 - protein, 26 aa, Plasmodium falciparum
INIFQKAVMMFLIELVNKTLEFKDEK

SEQ ID NO: 3384813 - protein, 37 aa, Plasmodium falciparum
INIFVTINFRNLIIDTLYLFKYIFNNKEFSLSMVDDL

SEQ ID NO: 3384814 - protein, 30 aa, Plasmodium falciparum
INIHRTLNDVWLFHIKTNKWNYLGTFTFQN

SEQ ID NO: 3384815 - protein, 18 aa, Plasmodium falciparum
INIIKKWTNKYAYKIYVK

SEQ ID NO: 3384816 - protein, 18 aa, Plasmodium falciparum
INIILKKIGASYFGDVDE

SEQ ID NO: 3384817 - protein, 17 aa, Plasmodium falciparum
INIINEKYLILEKEYEE

SEQ ID NO: 3384818 - protein, 21 aa, Plasmodium falciparum
INIIYKPLFDSAYNLIIDLIN

SEQ ID NO: 3384819 - protein, 33 aa, Plasmodium falciparum
INIIYYNDEYKNIIFINFLRLCQLNNMNVKKYH

SEQ ID NO: 3384820 - protein, 30 aa, Plasmodium falciparum
INIKDNILKSLLILLHYSLIRKKNASDIQN

SEQ ID NO: 3384821 - protein, 18 aa, Plasmodium falciparum
INILFSFHNACLSNYNKL

SEQ ID NO: 3384822 - protein, 17 aa, Plasmodium falciparum
INILMKYMDNEKKGYIN

SEQ ID NO: 3384823 - protein, 17 aa, Plasmodium falciparum
INILNKNLKYMKLKKNE

SEQ ID NO: 3384824 - protein, 21 aa, Plasmodium falciparum
INILNLYIKVEQPLILCISHI

SEQ ID NO: 3384825 - protein, 26 aa, Plasmodium falciparum
INILPYNNYIPLYKGFNNFEEYIINQ

SEQ ID NO: 3384826 - protein, 17 aa, Plasmodium falciparum
INIMIAMLETSYKSMQI

SEQ ID NO: 3384827 - protein, 25 aa, Plasmodium falciparum
ININDINLINYKKLNKNNLLSYIFK

SEQ ID NO: 3384828 - protein, 32 aa, Plasmodium falciparum
ININNPFDYFYLIRELKIVASMLNIAILIFDV

SEQ ID NO: 3384829 - protein, 21 aa, Plasmodium falciparum
INIPCNIEIPKYTRLSAYYTN

SEQ ID NO: 3384830 - protein, 23 aa, Plasmodium falciparum
INIPGFKKCLILSFVCPNCNFKT

SEQ ID NO: 3384831 - protein, 25 aa, Plasmodium falciparum
INIRKALLSGFYQQVAYKTTKGYYI

SEQ ID NO: 3384832 - protein, 20 aa, Plasmodium falciparum
INISHLWRNLHKEYLKIRKV

SEQ ID NO: 3384833 - protein, 27 aa, Plasmodium falciparum
INISTFKKHIINHIKDILLKRDVINRS

SEQ ID NO: 3384834 - protein, 37 aa, Plasmodium falciparum
INIVIKVIYINNIKKLIFKYLYLINNNFKHDGVGNIN

SEQ ID NO: 3384835 - protein, 17 aa, Plasmodium falciparum
INIVLNEEMNMPNVVNC

SEQ ID NO: 3384836 - protein, 31 aa, Plasmodium falciparum
INIVSTFYKYSLDKLIFKIYIPFDQINKHHN

SEQ ID NO: 3384837 - protein, 27 aa, Plasmodium falciparum
INIYIKDVLMNIVLDFYNIFEEELPKA

SEQ ID NO: 3384838 - protein, 25 aa, Plasmodium falciparum
INIYRLKYIYLLITSDNYLFNNFYT

SEQ ID NO: 3384839 - protein, 25 aa, Plasmodium falciparum
INKDFSELQYYNDKFMSGFNNIKKM

SEQ ID NO: 3384840 - protein, 22 aa, Plasmodium falciparum
INKELLINRKITQKCYLKINKL

SEQ ID NO: 3384841 - protein, 22 aa, Plasmodium falciparum
INKELYFIPEHSNWYKTNTQPF

SEQ ID NO: 3384842 - protein, 34 aa, Plasmodium falciparum
INKEQKYLALKNKNYKFLLHRYIQLYNVNEEHYE

SEQ ID NO: 3384843 - protein, 39 aa, Plasmodium falciparum
INKFNYYFVKLFINNKWYLIFVNLYLPYNKNNNQILSCY

SEQ ID NO: 3384844 - protein, 27 aa, Plasmodium falciparum
INKGILFMELLLYDIKFYHNSSMIEEN

SEQ ID NO: 3384845 - protein, 28 aa, Plasmodium falciparum
INKHHNYLFLLVTKKILWRYNVNFNISI

SEQ ID NO: 3384846 - protein, 31 aa, Plasmodium falciparum
INKILNLDNILSYIFKPVGSHMTKLINAFIH

SEQ ID NO: 3384847 - protein, 34 aa, Plasmodium falciparum
INKIPIPKIYLNIDDPKYLSWKILQNSGKTAFKE

SEQ ID NO: 3384848 - protein, 17 aa, Plasmodium falciparum
INKIYAQNKTICSNAPF

SEQ ID NO: 3384849 - protein, 17 aa, Plasmodium falciparum
INKKKNIKLYKKKKNKQ

SEQ ID NO: 3384850 - protein, 25 aa, Plasmodium falciparum
INKKKRFIFLLSSVGKELLLDNLLT

SEQ ID NO: 3384851 - protein, 24 aa, Plasmodium falciparum
INKKMPIEILHFFDYYINRKNELD

SEQ ID NO: 3384852 - protein, 27 aa, Plasmodium falciparum
INKLNDLNDYFFILGSTSTSRKYILKK

SEQ ID NO: 3384853 - protein, 20 aa, Plasmodium falciparum
INKNFIPCNYAKNKKKCTTT

SEQ ID NO: 3384854 - protein, 26 aa, Plasmodium falciparum
INKNGDILNSFNGNALPINYDRNEYA

SEQ ID NO: 3384855 - protein, 35 aa, Plasmodium falciparum
INKNICFDIFLFKQDFFDYDFSLGILKNKKSILNK

SEQ ID NO: 3384856 - protein, 33 aa, Plasmodium falciparum
INKNKLIENLRNTKLLLIKKRRSLNNMKKENNI

SEQ ID NO: 3384857 - protein, 24 aa, Plasmodium falciparum
INKNKMIAPPPYAGDNTASVNPHI

SEQ ID NO: 3384858 - protein, 36 aa, Plasmodium falciparum
INKQCNNTYFLKIKLYILCLIKLIEKYKLDPHSLCI

SEQ ID NO: 3384859 - protein, 20 aa, Plasmodium falciparum
INKYNIKILIKIYYDYITYI

SEQ ID NO: 3384860 - protein, 28 aa, Plasmodium falciparum
INLCNSAYYPHCTYSNPLKSIKKYSCTN

SEQ ID NO: 3384861 - protein, 29 aa, Plasmodium falciparum
INLEKCASWIYFDPLTWSKKTYNNYLNVK

SEQ ID NO: 3384862 - protein, 19 aa, Plasmodium falciparum
INLESIWQAIYTAGVYLPK

SEQ ID NO: 3384863 - protein, 20 aa, Plasmodium falciparum
INLFDYIHLTNIVGALRSLE

SEQ ID NO: 3384864 - protein, 21 aa, Plasmodium falciparum
INLFNVYKLFHNKKKKSWMIM

SEQ ID NO: 3384865 - protein, 17 aa, Plasmodium falciparum
INLFQNKYILNIDKSFF

SEQ ID NO: 3384866 - protein, 26 aa, Plasmodium falciparum
INLFYSKFFQDYITNPVLLPIKEISN

SEQ ID NO: 3384867 - protein, 29 aa, Plasmodium falciparum
INLHYPVDIELIYYLFSKCGTVEKIITFS

SEQ ID NO: 3384868 - protein, 24 aa, Plasmodium falciparum
INLKSINRFNTVSLGLKGNHNMEN

SEQ ID NO: 3384869 - protein, 19 aa, Plasmodium falciparum
INLLTPYINFGIISSQRCV

SEQ ID NO: 3384870 - protein, 23 aa, Plasmodium falciparum
INLNHMYYNFPSSYYVFNYLFND

SEQ ID NO: 3384871 - protein, 31 aa, Plasmodium falciparum
INLRKSPVLLYLYYLKQIGLALSPLSNNALF

SEQ ID NO: 3384872 - protein, 31 aa, Plasmodium falciparum
INLSNLYMKLTYLNFEIFKYLKVLDLSNNGI

SEQ ID NO: 3384873 - protein, 43 aa, Plasmodium falciparum
INLSQTCKFFYKRKFKVAYNRLIFKSYLGYNPKILYEYVFPVI

SEQ ID NO: 3384874 - protein, 19 aa, Plasmodium falciparum
INMNNKRVYAMKVVLKECN

SEQ ID NO: 3384875 - protein, 29 aa, Plasmodium falciparum
INMQNLFKNIPQPSLLFPYVLTMSNNVLN

SEQ ID NO: 3384876 - protein, 23 aa, Plasmodium falciparum
INNDLENYYFYNKHIYNSMDDLY

SEQ ID NO: 3384877 - protein, 29 aa, Plasmodium falciparum
INNEGLYKSSFYYIKLNENSRYNYNNHDD

SEQ ID NO: 3384878 - protein, 28 aa, Plasmodium falciparum
INNEIREWLLLFLLPNFIHKSIHKVTYP

SEQ ID NO: 3384879 - protein, 17 aa, Plasmodium falciparum
INNFPIHKKNCIIFLLL

SEQ ID NO: 3384880 - protein, 20 aa, Plasmodium falciparum
INNFYIIEFLEIGGIQTYSY

SEQ ID NO: 3384881 - protein, 20 aa, Plasmodium falciparum
INNIIKLYESVRNNLFKFIN

SEQ ID NO: 3384882 - protein, 20 aa, Plasmodium falciparum
INNIIYIRIDQNFLSKLMEQ

SEQ ID NO: 3384883 - protein, 27 aa, Plasmodium falciparum
INNIYDIDFFHPLTIRASSGYLLDIPF

SEQ ID NO: 3384884 - protein, 24 aa, Plasmodium falciparum
INNKKGMMKYLNKIVNPANQSYSI

SEQ ID NO: 3384885 - protein, 23 aa, Plasmodium falciparum
INNKLLCHIWEKAYQFINEYTLQ

SEQ ID NO: 3384886 - protein, 20 aa, Plasmodium falciparum
INNKMNWQKKGFMLEQNREK

SEQ ID NO: 3384887 - protein, 32 aa, Plasmodium falciparum
INNKNPYIFTCQKYFMRPSNVLHNIQNCGIHK

SEQ ID NO: 3384888 - protein, 26 aa, Plasmodium falciparum
INNKNRFCFFIYIKDFSASYSTINNN

SEQ ID NO: 3384889 - protein, 26 aa, Plasmodium falciparum
INNKRSYFIKNLYLSSLFSSDYITYI

SEQ ID NO: 3384890 - protein, 24 aa, Plasmodium falciparum
INNKSLELIPSKRPLVSYSTYDNQ

SEQ ID NO: 3384891 - protein, 33 aa, Plasmodium falciparum
INNLKVNIIMHFLNFFHLNDMYTILNDYTYYFS

SEQ ID NO: 3384892 - protein, 17 aa, Plasmodium falciparum
INNLLFKKQAKDKTYEL

SEQ ID NO: 3384893 - protein, 27 aa, Plasmodium falciparum
INNLWSSFFEPNSLYEIAGHRNEILKL

SEQ ID NO: 3384894 - protein, 24 aa, Plasmodium falciparum
INNNDKNLLILDKNKKKTSNNKKN

SEQ ID NO: 3384895 - protein, 18 aa, Plasmodium falciparum
INNNIVLDSILNNNIMNN

SEQ ID NO: 3384896 - protein, 25 aa, Plasmodium falciparum
INNNQGIILGIKPYDNINKINNVPT

SEQ ID NO: 3384897 - protein, 18 aa, Plasmodium falciparum
INNNYLNHLTNNLSHHNN

SEQ ID NO: 3384898 - protein, 25 aa, Plasmodium falciparum
INNQMNFMKWSPQGTYFILASLASE

SEQ ID NO: 3384899 - protein, 24 aa, Plasmodium falciparum
INNSQLLIDNFNLLEEKHLQLIDD

SEQ ID NO: 3384900 - protein, 22 aa, Plasmodium falciparum
INNYNMLSLIMRIPIVIKKKKP

SEQ ID NO: 3384901 - protein, 24 aa, Plasmodium falciparum
INQIKEFELMYPDGFIKYIEKGRE

SEQ ID NO: 3384902 - protein, 31 aa, Plasmodium falciparum
INQVPVIEKILYEEFLPFGNIEYVRYIPNKN

SEQ ID NO: 3384903 - protein, 24 aa, Plasmodium falciparum
INQVQKIIKLFLLLCPHNQIEQMD

SEQ ID NO: 3384904 - protein, 25 aa, Plasmodium falciparum
INRMKYYGVILFSSNLIYYINDFHE

SEQ ID NO: 3384905 - protein, 19 aa, Plasmodium falciparum
INSCCRIFYDKPIEFLHII

SEQ ID NO: 3384906 - protein, 17 aa, Plasmodium falciparum
INSIHIINNFFSPNENN

SEQ ID NO: 3384907 - protein, 23 aa, Plasmodium falciparum
INSIVVFFIGGATYEEYRDVQHL

SEQ ID NO: 3384908 - protein, 22 aa, Plasmodium falciparum
INSNFDSFILKKLKIINDPDCN

SEQ ID NO: 3384909 - protein, 33 aa, Plasmodium falciparum
INSNNNIIEPKKKKLLFFKKKINNKINTITNNI

SEQ ID NO: 3384910 - protein, 23 aa, Plasmodium falciparum
INSSYLSFVLNIGTSYYSNEEIK

SEQ ID NO: 3384911 - protein, 25 aa, Plasmodium falciparum
INSTNTSIPIYPYEYKKIRKKLETY

SEQ ID NO: 3384912 - protein, 64 aa, Plasmodium falciparum
INSVKHPMTYIKGFEYASDSINFLKALKGLPPLPFLKCKDMKPYMRLFNIVLKVIESNDYNVDN

SEQ ID NO: 3384913 - protein, 23 aa, Plasmodium falciparum
INSWIDLIFGYKQNGHNAKECFN

SEQ ID NO: 3384914 - protein, 22 aa, Plasmodium falciparum
INSYLYISWNIGNVIYRNLYNS

SEQ ID NO: 3384915 - protein, 18 aa, Plasmodium falciparum
INSYYQFCLEHFINFFTY

SEQ ID NO: 3384916 - protein, 31 aa, Plasmodium falciparum
INTCNKIFTHLIVCLLPDGGINKLRVYGEIK

SEQ ID NO: 3384917 - protein, 29 aa, Plasmodium falciparum
INTERFYYCIRYCSIFSFVLNKIIQKKVQ

SEQ ID NO: 3384918 - protein, 25 aa, Plasmodium falciparum
INTEYLPSNLLNSISINNVSQSNQI

SEQ ID NO: 3384919 - protein, 24 aa, Plasmodium falciparum
INTFCSFLKILKPPNVSALLNYND

SEQ ID NO: 3384920 - protein, 24 aa, Plasmodium falciparum
INTILYARDKYLKENGYIFPNKIY

SEQ ID NO: 3384921 - protein, 22 aa, Plasmodium falciparum
INTLKQNYYYLKKEYDLKNKEL

SEQ ID NO: 3384922 - protein, 28 aa, Plasmodium falciparum
INTNLHLLNIFIPKPVISVAVEILKKGD

SEQ ID NO: 3384923 - protein, 23 aa, Plasmodium falciparum
INTQFLMPLKIHSTINHFITTHN

SEQ ID NO: 3384924 - protein, 27 aa, Plasmodium falciparum
INTTNLNYHKYYYTYSINNMSEKKKKN

SEQ ID NO: 3384925 - protein, 21 aa, Plasmodium falciparum
INTYFVITEIKLIDIKNFCTS

SEQ ID NO: 3384926 - protein, 19 aa, Plasmodium falciparum
INTYGMTLYAIFNKLFIFY

SEQ ID NO: 3384927 - protein, 28 aa, Plasmodium falciparum
INVDKNLFRFFLETLFYEYMTDERFKST

SEQ ID NO: 3384928 - protein, 32 aa, Plasmodium falciparum
INVGDSYQVSNLPNFFLCRSELMYKNYDTQEN

SEQ ID NO: 3384929 - protein, 18 aa, Plasmodium falciparum
INVILENCVHEWFPFLKD

SEQ ID NO: 3384930 - protein, 25 aa, Plasmodium falciparum
INVKSILCIFTSKISGYLTSVGFFN

SEQ ID NO: 3384931 - protein, 22 aa, Plasmodium falciparum
INVLFDIFDLNADGFIQKSEMV

SEQ ID NO: 3384932 - protein, 29 aa, Plasmodium falciparum
INVLKYSNFIYFHIFMICVTYANQTKIVG

SEQ ID NO: 3384933 - protein, 18 aa, Plasmodium falciparum
INVLNKDGAILYKVQDEN

SEQ ID NO: 3384934 - protein, 24 aa, Plasmodium falciparum
INVQIYPLYIKYHEYSYKLCGALF

SEQ ID NO: 3384935 - protein, 21 aa, Plasmodium falciparum
INVSAQCKGILLSTVSPRKMS

SEQ ID NO: 3384936 - protein, 18 aa, Plasmodium falciparum
INYFLEICPTVLDCSRKE

SEQ ID NO: 3384937 - protein, 27 aa, Plasmodium falciparum
INYGKPYKLSCLESLAFCLYVCNYNKQ

SEQ ID NO: 3384938 - protein, 19 aa, Plasmodium falciparum
INYILSNLPCYYWYKREED

SEQ ID NO: 3384939 - protein, 25 aa, Plasmodium falciparum
INYKDRFYFEPILYNNQRDINKHMN

SEQ ID NO: 3384940 - protein, 29 aa, Plasmodium falciparum
INYLKPPVMNLIRNNIYFNRNTLGKNDKT

SEQ ID NO: 3384941 - protein, 18 aa, Plasmodium falciparum
INYLKYLNYWRNKPYIFY

SEQ ID NO: 3384942 - protein, 34 aa, Plasmodium falciparum
INYMNKKYFDDLNNIYFLLEDFTNTYKTCSNNLK

SEQ ID NO: 3384943 - protein, 19 aa, Plasmodium falciparum
INYMNLYDILNERIEYIVE

SEQ ID NO: 3384944 - protein, 32 aa, Plasmodium falciparum
INYMNRINNMSYLNNTIPLNCINVFNHINDNL

SEQ ID NO: 3384945 - protein, 26 aa, Plasmodium falciparum
INYTTPRALLAILRISQALARLRDSD

SEQ ID NO: 3384946 - protein, 44 aa, Plasmodium falciparum
INYYNSIKSDFFFLNYISISKYILLILSKFLNIHLIDKFECIHI

SEQ ID NO: 3384947 - protein, 37 aa, Plasmodium falciparum
INYYSVKWINFINRKVPILLQNKSGPCPLLCITNILL

SEQ ID NO: 3384948 - protein, 18 aa, Plasmodium falciparum
IPCPRYFSSLDLYIIRKN

SEQ ID NO: 3384949 - protein, 17 aa, Plasmodium falciparum
IPCRYIRYVKNKTVHYF

SEQ ID NO: 3384950 - protein, 21 aa, Plasmodium falciparum
IPCTYKWTRVYYNKECELVEK

SEQ ID NO: 3384951 - protein, 26 aa, Plasmodium falciparum
IPDALLMHLPHMKILLSEISDILNEA

SEQ ID NO: 3384952 - protein, 17 aa, Plasmodium falciparum
IPDIYFRNILKEFCIQK

SEQ ID NO: 3384953 - protein, 21 aa, Plasmodium falciparum
IPEALRHNLIKPYSVYTEKKK

SEQ ID NO: 3384954 - protein, 25 aa, Plasmodium falciparum
IPEDFIRQMYYTFGDYRDLCMNKNI

SEQ ID NO: 3384955 - protein, 23 aa, Plasmodium falciparum
IPEDKYHYFKTLKPTRTKFSTFK

SEQ ID NO: 3384956 - protein, 21 aa, Plasmodium falciparum
IPEYFKKYPIYYAGPAKTPDN

SEQ ID NO: 3384957 - protein, 20 aa, Plasmodium falciparum
IPFLHYDLKSAQSLVSFNKL

SEQ ID NO: 3384958 - protein, 19 aa, Plasmodium falciparum
IPFSKRYIKYLAKKYIKMH

SEQ ID NO: 3384959 - protein, 19 aa, Plasmodium falciparum
IPGLQFLEYVKKNRFNIWD

SEQ ID NO: 3384960 - protein, 27 aa, Plasmodium falciparum
IPGQTKYWQFIKLTNKIYLIDCPGIVP

SEQ ID NO: 3384961 - protein, 20 aa, Plasmodium falciparum
IPHCINYIFNYINYHKQQDK

SEQ ID NO: 3384962 - protein, 17 aa, Plasmodium falciparum
IPIAIRFSCTFNGSQEV

SEQ ID NO: 3384963 - protein, 28 aa, Plasmodium falciparum
IPIDEIREYWWALNRKEVWKALTCSGFR

SEQ ID NO: 3384964 - protein, 18 aa, Plasmodium falciparum
IPIHQWYMNNVRRNIYNT

SEQ ID NO: 3384965 - protein, 23 aa, Plasmodium falciparum
IPIIKIVLAIYYLFNDNNKESFL

SEQ ID NO: 3384966 - protein, 18 aa, Plasmodium falciparum
IPIIYYTHYNMNFLNELY

SEQ ID NO: 3384967 - protein, 26 aa, Plasmodium falciparum
IPIKNKSLNIYYAFQSHIKPPSFVFF

SEQ ID NO: 3384968 - protein, 21 aa, Plasmodium falciparum
IPKITILLFHTPTFSYKPHDK

SEQ ID NO: 3384969 - protein, 17 aa, Plasmodium falciparum
IPKKDIEIIPLKNKESL

SEQ ID NO: 3384970 - protein, 34 aa, Plasmodium falciparum
IPKKKILHFTLVDINIPILYILKKKNNVNYFNEF

SEQ ID NO: 3384971 - protein, 25 aa, Plasmodium falciparum
IPKNFTFIRWLCLTDCLLVCFFDEQ

SEQ ID NO: 3384972 - protein, 34 aa, Plasmodium falciparum
IPLEEHKDILLKIKSLPLIQKLCLYASCNVVNDT

SEQ ID NO: 3384973 - protein, 19 aa, Plasmodium falciparum
IPLIKRKCEYFNTSNLAML

SEQ ID NO: 3384974 - protein, 18 aa, Plasmodium falciparum
IPLLFSKVNNCLAFLSFK

SEQ ID NO: 3384975 - protein, 19 aa, Plasmodium falciparum
IPLPNIKTPILKKIIEYME

SEQ ID NO: 3384976 - protein, 18 aa, Plasmodium falciparum
IPNDKFSLCLWDSDVFLY

SEQ ID NO: 3384977 - protein, 20 aa, Plasmodium falciparum
IPNILDFIELILIKEINHFN

SEQ ID NO: 3384978 - protein, 21 aa, Plasmodium falciparum
IPNIYPIKVNVIYKLLNIIKK

SEQ ID NO: 3384979 - protein, 24 aa, Plasmodium falciparum
IPNKNNHVLLKPERNFISGIDNTM

SEQ ID NO: 3384980 - protein, 17 aa, Plasmodium falciparum
IPNKRYIYLNGDDSNYK

SEQ ID NO: 3384981 - protein, 23 aa, Plasmodium falciparum
IPNTICNMTCNFFVSVNNCHILE

SEQ ID NO: 3384982 - protein, 17 aa, Plasmodium falciparum
IPPIIKKIERKSNDNDN

SEQ ID NO: 3384983 - protein, 31 aa, Plasmodium falciparum
IPPRKIETKPKLPSKFNPLKKEPLKKTKTNL

SEQ ID NO: 3384984 - protein, 26 aa, Plasmodium falciparum
IPQRFRWMTEWSEYYCKALKVELEKL

SEQ ID NO: 3384985 - protein, 33 aa, Plasmodium falciparum
IPRKKQFYKTKMCPWFFSGRCDRGMECLFAHSQ

SEQ ID NO: 3384986 - protein, 32 aa, Plasmodium falciparum
IPSIEQFYKDNNFYYFLRKEKMYTGSIQPVIA

SEQ ID NO: 3384987 - protein, 26 aa, Plasmodium falciparum
IPSNTIPPCVIYYNKKKFKDNISEKN

SEQ ID NO: 3384988 - protein, 17 aa, Plasmodium falciparum
IPSTLNKDSFCSFTTVS

SEQ ID NO: 3384989 - protein, 21 aa, Plasmodium falciparum
IPSVYKIKIFLISSDKSSIIK

SEQ ID NO: 3384990 - protein, 19 aa, Plasmodium falciparum
IPTNLGIALVQSYKKFKDI

SEQ ID NO: 3384991 - protein, 27 aa, Plasmodium falciparum
IPTSLIPRYPIDWRNGGRFLLCVGMRR

SEQ ID NO: 3384992 - protein, 25 aa, Plasmodium falciparum
IPTTYDNLAIIKLIIKKKNNNNSNC

SEQ ID NO: 3384993 - protein, 24 aa, Plasmodium falciparum
IPVENIVLLYKGAPLNNFLTLKES

SEQ ID NO: 3384994 - protein, 21 aa, Plasmodium falciparum
IPVHKLACATILKALERSQIE

SEQ ID NO: 3384995 - protein, 29 aa, Plasmodium falciparum
IPYCTKYSKRIISILLMTLNKNPQKRIDT

SEQ ID NO: 3384996 - protein, 25 aa, Plasmodium falciparum
IPYENYEFGLRRMYTIDTSDLTNKQ

SEQ ID NO: 3384997 - protein, 17 aa, Plasmodium falciparum
IPYNSECSFLINVPSSI

SEQ ID NO: 3384998 - protein, 18 aa, Plasmodium falciparum
IPYPYGVLDLKLGAHKSN

SEQ ID NO: 3384999 - protein, 24 aa, Plasmodium falciparum
IPYSNFILPMLIKRKMINDLYNDN

SEQ ID NO: 3385000 - protein, 26 aa, Plasmodium falciparum
IPYSVTTFYCPVKFPYTDNIIYKSDQ

SEQ ID NO: 3385001 - protein, 24 aa, Plasmodium falciparum
IPYYNKLVLLYISKVLFNGTLNIL

SEQ ID NO: 3385002 - protein, 17 aa, Plasmodium falciparum
IQDLFSYYHEFVKSIQE

SEQ ID NO: 3385003 - protein, 24 aa, Plasmodium falciparum
IQDMNKFLYGLILLYTCDTSIDID

SEQ ID NO: 3385004 - protein, 18 aa, Plasmodium falciparum
IQDNACKELLLSFVQAKK

SEQ ID NO: 3385005 - protein, 19 aa, Plasmodium falciparum
IQEAFYKFKSLQSLNYHIV

SEQ ID NO: 3385006 - protein, 17 aa, Plasmodium falciparum
IQEILDIYYSIIRNNKN

SEQ ID NO: 3385007 - protein, 17 aa, Plasmodium falciparum
IQEIPFVDYYNYKYEKL

SEQ ID NO: 3385008 - protein, 27 aa, Plasmodium falciparum
IQEKPTRWRRIYKGLKLCEYVMKNGCE

SEQ ID NO: 3385009 - protein, 18 aa, Plasmodium falciparum
IQFVSPPELIRGLKERYI

SEQ ID NO: 3385010 - protein, 25 aa, Plasmodium falciparum
IQGNYRAILLLKIIKHKINFNYINK

SEQ ID NO: 3385011 - protein, 22 aa, Plasmodium falciparum
IQHKSLYPCTITCMMNGSIGGI

SEQ ID NO: 3385012 - protein, 18 aa, Plasmodium falciparum
IQIFNKLIYEENRAYLFI

SEQ ID NO: 3385013 - protein, 27 aa, Plasmodium falciparum
IQIKGRKKILLIPPKYIQYFNIIDSSS

SEQ ID NO: 3385014 - protein, 25 aa, Plasmodium falciparum
IQINNLFCILTKPYPYIVASCITGG

SEQ ID NO: 3385015 - protein, 40 aa, Plasmodium falciparum
IQKCKTKVFFYINPKYIIEPLKRKIYQNMSIYIENLISDV

SEQ ID NO: 3385016 - protein, 37 aa, Plasmodium falciparum
IQKGHNLWSLPFIQAAKLERLNILKYLYSVKKEIINQ

SEQ ID NO: 3385017 - protein, 27 aa, Plasmodium falciparum
IQKISYSFLIKLLYTLNFYSSLSNDDL

SEQ ID NO: 3385018 - protein, 24 aa, Plasmodium falciparum
IQKLISCNNWKQVPSIYKKSAENI

SEQ ID NO: 3385019 - protein, 26 aa, Plasmodium falciparum
IQKLKNQHILLFNSLSNQSLLLDMQN

SEQ ID NO: 3385020 - protein, 29 aa, Plasmodium falciparum
IQKNYRTYILRKKFLYMKKQILFIQDYYL

SEQ ID NO: 3385021 - protein, 18 aa, Plasmodium falciparum
IQKRNHIFCVKKSGPFCG

SEQ ID NO: 3385022 - protein, 52 aa, Plasmodium falciparum
IQLESMKCIILFCSLYKIKYFQGMHDMIISLFYLNLETYEIFCVFEKILHYY

SEQ ID NO: 3385023 - protein, 33 aa, Plasmodium falciparum
IQLLKNIQNWVYCKFSFLPNGHIFYPKSGNLKK

SEQ ID NO: 3385024 - protein, 26 aa, Plasmodium falciparum
IQLNGGIYINKFKLSLDMPINKLAVS

SEQ ID NO: 3385025 - protein, 22 aa, Plasmodium falciparum
IQLNRIPYPFPTLKLNPDIKNI

SEQ ID NO: 3385026 - protein, 19 aa, Plasmodium falciparum
IQLYPKFNKINSKLALKLF

SEQ ID NO: 3385027 - protein, 18 aa, Plasmodium falciparum
IQMCKFLLDFIHLKLIKT

SEQ ID NO: 3385028 - protein, 27 aa, Plasmodium falciparum
IQMNVLYDLIFLLKLKKKTSNLCDDNI

SEQ ID NO: 3385029 - protein, 33 aa, Plasmodium falciparum
IQNENSYINIKYFFLFILDVSNDYIIYENFLQQ

SEQ ID NO: 3385030 - protein, 27 aa, Plasmodium falciparum
IQNNDKGYMYPNYNTALNIMNPNENGD

SEQ ID NO: 3385031 - protein, 23 aa, Plasmodium falciparum
IQQYRKTLTKIVKIKTAIFHETV

SEQ ID NO: 3385032 - protein, 23 aa, Plasmodium falciparum
IQREILPHAFLKKDIIGLSETGS

SEQ ID NO: 3385033 - protein, 31 aa, Plasmodium falciparum
IQREPPINSYNNPLGFKPLNYDDPNSIPINY

SEQ ID NO: 3385034 - protein, 17 aa, Plasmodium falciparum
IQRHKIVLSKKKRKLFA

SEQ ID NO: 3385035 - protein, 24 aa, Plasmodium falciparum
IQRKIFVGGLNYYWTKDTLESYFS

SEQ ID NO: 3385036 - protein, 18 aa, Plasmodium falciparum
IQRRKLLEYYFKKNEIML

SEQ ID NO: 3385037 - protein, 19 aa, Plasmodium falciparum
IQRTMLELLNQLDGFDSRG

SEQ ID NO: 3385038 - protein, 27 aa, Plasmodium falciparum
IQSHIRRYLMVRFYKTYRQNYYASKIQ

SEQ ID NO: 3385039 - protein, 25 aa, Plasmodium falciparum
IQSSLRFAMLLLEPSRILATLEGNT

SEQ ID NO: 3385040 - protein, 19 aa, Plasmodium falciparum
IQSYKYILSVSFDYNYLKI

SEQ ID NO: 3385041 - protein, 36 aa, Plasmodium falciparum
IQTKTPYECIYKFISMPLSNPYFDLNNLYDINNISL

SEQ ID NO: 3385042 - protein, 24 aa, Plasmodium falciparum
IQTMSKFYFYIHVKLFTCNVDNLK

SEQ ID NO: 3385043 - protein, 25 aa, Plasmodium falciparum
IQTQDRSIFLYNTPQNYIPMESKQD

SEQ ID NO: 3385044 - protein, 22 aa, Plasmodium falciparum
IQTQILYNRNLIQLGLCAFRHG

SEQ ID NO: 3385045 - protein, 27 aa, Plasmodium falciparum
IQVLAKEYLCKYTFLLVGKVGSTNEYI

SEQ ID NO: 3385046 - protein, 21 aa, Plasmodium falciparum
IQVYEISNLLIAYDLSKKLLT

SEQ ID NO: 3385047 - protein, 26 aa, Plasmodium falciparum
IQYKKAFDICRFSKIYNLIFEEKKKV

SEQ ID NO: 3385048 - protein, 27 aa, Plasmodium falciparum
IQYVDNFTLIFKIYQGFHKIIRKMCML

SEQ ID NO: 3385049 - protein, 18 aa, Plasmodium falciparum
IRCLLDKIMLRRLKEQAI

SEQ ID NO: 3385050 - protein, 25 aa, Plasmodium falciparum
IRCNSLDYILRYKNNLTFNNEKTSP

SEQ ID NO: 3385051 - protein, 26 aa, Plasmodium falciparum
IRDALSRAIYGCLFLKVVERTNESIG

SEQ ID NO: 3385052 - protein, 29 aa, Plasmodium falciparum
IRDCTIIQPQWLIQLAPNLFIPADEKKIS

SEQ ID NO: 3385053 - protein, 28 aa, Plasmodium falciparum
IRDKVHDLFKLWRYHSKKLLKDFAKSFD

SEQ ID NO: 3385054 - protein, 36 aa, Plasmodium falciparum
IRDNEMFFKIWMKNYSNYLKNILMKKLRDAYNVYNN

SEQ ID NO: 3385055 - protein, 26 aa, Plasmodium falciparum
IRECVTEFIQFLTSEASDRCTREKRK

SEQ ID NO: 3385056 - protein, 17 aa, Plasmodium falciparum
IREDILQNEKFPFIFYD

SEQ ID NO: 3385057 - protein, 23 aa, Plasmodium falciparum
IREIMNDPLLKKYKFLILDEIHE

SEQ ID NO: 3385058 - protein, 18 aa, Plasmodium falciparum
IRENISLSQLNLKIKELK

SEQ ID NO: 3385059 - protein, 45 aa, Plasmodium falciparum
IRFHTEIFLKQITMLSLLRLELKRRWLRILFILECFLCKSKSHCS

SEQ ID NO: 3385060 - protein, 18 aa, Plasmodium falciparum
IRFMQSSFCRFSNIKTKA

SEQ ID NO: 3385061 - protein, 24 aa, Plasmodium falciparum
IRGNNIRYFILSDSLPLDSLLVED

SEQ ID NO: 3385062 - protein, 19 aa, Plasmodium falciparum
IRHFWKNYYEDVDGIIFVV

SEQ ID NO: 3385063 - protein, 20 aa, Plasmodium falciparum
IRHRFIHNIFDYIKDIFSNK

SEQ ID NO: 3385064 - protein, 19 aa, Plasmodium falciparum
IRILSYNILAPIYTNTKYA

SEQ ID NO: 3385065 - protein, 25 aa, Plasmodium falciparum
IRINQCLKIFFYLTANKKELDEQSK

SEQ ID NO: 3385066 - protein, 32 aa, Plasmodium falciparum
IRIPLFKEINKEIFEKLPLKLQYQILQDIKEE

SEQ ID NO: 3385067 - protein, 17 aa, Plasmodium falciparum
IRKELSEDPIISKYFRI

SEQ ID NO: 3385068 - protein, 25 aa, Plasmodium falciparum
IRKERYIAFLLDRNSDGIILLGSSI

SEQ ID NO: 3385069 - protein, 18 aa, Plasmodium falciparum
IRKINYIKKFLSTGSPVD

SEQ ID NO: 3385070 - protein, 17 aa, Plasmodium falciparum
IRKIYKDMKHIYNEYNN

SEQ ID NO: 3385071 - protein, 30 aa, Plasmodium falciparum
IRKKIKNSLKMKYPFIINFNIKKNKYQNVN

SEQ ID NO: 3385072 - protein, 23 aa, Plasmodium falciparum
IRKKKIGCLFPPCYSQLLINFCV

SEQ ID NO: 3385073 - protein, 18 aa, Plasmodium falciparum
IRKKYLKAALILHPDKKE

SEQ ID NO: 3385074 - protein, 31 aa, Plasmodium falciparum
IRKMNFYYQSFFQKYFIFINSNIKKINEMSD

SEQ ID NO: 3385075 - protein, 23 aa, Plasmodium falciparum
IRKRTLSFLMENKKYIDNFIQMN

SEQ ID NO: 3385076 - protein, 18 aa, Plasmodium falciparum
IRKYISLNILIQNSMENL

SEQ ID NO: 3385077 - protein, 19 aa, Plasmodium falciparum
IRKYNIYKMIYSYSKNVEN

SEQ ID NO: 3385078 - protein, 26 aa, Plasmodium falciparum
IRLFDHLAVILIYEELLKNPLCKITN

SEQ ID NO: 3385079 - protein, 20 aa, Plasmodium falciparum
IRLILQYLKENNLIRSFYVL

SEQ ID NO: 3385080 - protein, 26 aa, Plasmodium falciparum
IRLLKIHIFVTYNGDFFDIPYLYRRC

SEQ ID NO: 3385081 - protein, 17 aa, Plasmodium falciparum
IRLYVKRVFINDKFSES

SEQ ID NO: 3385082 - protein, 29 aa, Plasmodium falciparum
IRNGINEMILFGKVFFQKFNENILLESCG

SEQ ID NO: 3385083 - protein, 18 aa, Plasmodium falciparum
IRNHLFLYNMIIMNIEHI

SEQ ID NO: 3385084 - protein, 29 aa, Plasmodium falciparum
IRNIDKHFYYFKIKGISFLYNQIRHMVAI

SEQ ID NO: 3385085 - protein, 20 aa, Plasmodium falciparum
IRNSVQITRFLIMKSQNHIM

SEQ ID NO: 3385086 - protein, 17 aa, Plasmodium falciparum
IRPPQPSVYLFLIDVTV

SEQ ID NO: 3385087 - protein, 24 aa, Plasmodium falciparum
IRQKKHFMVKYKNYYIHYAEKVMN

SEQ ID NO: 3385088 - protein, 25 aa, Plasmodium falciparum
IRRCELFDIVLFNPPYVITGPDEMN

SEQ ID NO: 3385089 - protein, 24 aa, Plasmodium falciparum
IRREIWHNPLSYYLGLEEFDEFDD

SEQ ID NO: 3385090 - protein, 24 aa, Plasmodium falciparum
IRTCIKFLVILYIDLEEEVKYFYS

SEQ ID NO: 3385091 - protein, 23 aa, Plasmodium falciparum
IRTEYKIAFPYLYNNRPRKIAVS

SEQ ID NO: 3385092 - protein, 23 aa, Plasmodium falciparum
IRTLKLHEFLKSVFQFIRFYCIM

SEQ ID NO: 3385093 - protein, 19 aa, Plasmodium falciparum
IRVLFYKIKIIASKYKKCI

SEQ ID NO: 3385094 - protein, 24 aa, Plasmodium falciparum
IRVRWMIQVPRLYHIYKKMKLINT

SEQ ID NO: 3385095 - protein, 17 aa, Plasmodium falciparum
IRVWSAADGKFLAVYRG

SEQ ID NO: 3385096 - protein, 18 aa, Plasmodium falciparum
IRYTNLNDHLLLIKNGDF

SEQ ID NO: 3385097 - protein, 22 aa, Plasmodium falciparum
IRYVGLCTLQKLLKKDPKTLHI

SEQ ID NO: 3385098 - protein, 28 aa, Plasmodium falciparum
ISACLILFLLNLFDKPFSKLILYPGSLV

SEQ ID NO: 3385099 - protein, 21 aa, Plasmodium falciparum
ISAKIEYFQNLLREEGITPQN

SEQ ID NO: 3385100 - protein, 19 aa, Plasmodium falciparum
ISAKLSLIPVRRGYWGNKI

SEQ ID NO: 3385101 - protein, 25 aa, Plasmodium falciparum
ISAYLYNSRLYILGNWNYISKELFN

SEQ ID NO: 3385102 - protein, 21 aa, Plasmodium falciparum
ISCAWVFFERLVMKGYVHKYN

SEQ ID NO: 3385103 - protein, 26 aa, Plasmodium falciparum
ISDDDVVCKYFFKKKLKKMNEENSLL

SEQ ID NO: 3385104 - protein, 25 aa, Plasmodium falciparum
ISDEKLFFLKINLKENIHLYKMFQG

SEQ ID NO: 3385105 - protein, 18 aa, Plasmodium falciparum
ISDRLINSPALLVQGEMG

SEQ ID NO: 3385106 - protein, 23 aa, Plasmodium falciparum
ISDTLFVDFLSSLLQIDPSKRCN

SEQ ID NO: 3385107 - protein, 24 aa, Plasmodium falciparum
ISDWLEQLFVFNKNLINNGLQMNE

SEQ ID NO: 3385108 - protein, 24 aa, Plasmodium falciparum
ISEHNVITAVQLKDLLLSINESAQ

SEQ ID NO: 3385109 - protein, 23 aa, Plasmodium falciparum
ISEIKHIIKKYIYNIFSQVVNKC

SEQ ID NO: 3385110 - protein, 21 aa, Plasmodium falciparum
ISELFFSNFFSKYNYDYICAF

SEQ ID NO: 3385111 - protein, 24 aa, Plasmodium falciparum
ISENSYLLALLNKELQNVIYHILN

SEQ ID NO: 3385112 - protein, 17 aa, Plasmodium falciparum
ISEQLRKRSRTTFKLKN

SEQ ID NO: 3385113 - protein, 18 aa, Plasmodium falciparum
ISERKKNYPTRNKILNNM

SEQ ID NO: 3385114 - protein, 18 aa, Plasmodium falciparum
ISEYDFYLCLNKLNISIT

SEQ ID NO: 3385115 - protein, 23 aa, Plasmodium falciparum
ISFCSELLPFYCKSEIIHQGDIF

SEQ ID NO: 3385116 - protein, 22 aa, Plasmodium falciparum
ISFFYHVPLFQKRKLTTFALRK

SEQ ID NO: 3385117 - protein, 21 aa, Plasmodium falciparum
ISFKLKRIHNIPRNNLHNYNI

SEQ ID NO: 3385118 - protein, 17 aa, Plasmodium falciparum
ISFLKYFKNVNITCYFL

SEQ ID NO: 3385119 - protein, 23 aa, Plasmodium falciparum
ISFNSFVYTNYYSDNYFSDRTKV

SEQ ID NO: 3385120 - protein, 18 aa, Plasmodium falciparum
ISFTGNICKIAKDQTGCR

SEQ ID NO: 3385121 - protein, 32 aa, Plasmodium falciparum
ISGCFFVEKLNAYLFAMLDKCSNKTVISVFPY

SEQ ID NO: 3385122 - protein, 24 aa, Plasmodium falciparum
ISHRNTFLWGCYFIDIGETNDKRN

SEQ ID NO: 3385123 - protein, 18 aa, Plasmodium falciparum
ISHYIIECYYVSKNIFSI

SEQ ID NO: 3385124 - protein, 18 aa, Plasmodium falciparum
ISICCFYTSLYVEYMMES

SEQ ID NO: 3385125 - protein, 29 aa, Plasmodium falciparum
ISIDYFLKSIIPIKPPLRIQYLATEQIQH

SEQ ID NO: 3385126 - protein, 23 aa, Plasmodium falciparum
ISIENVLKKMKKKKKSDLCINHD

SEQ ID NO: 3385127 - protein, 25 aa, Plasmodium falciparum
ISIIKIKMLLLRRPDIKTIAEKSIV

SEQ ID NO: 3385128 - protein, 36 aa, Plasmodium falciparum
ISILLKSFLKYKYFHISLLKLLMYICNNKSYPQLRD

SEQ ID NO: 3385129 - protein, 24 aa, Plasmodium falciparum
ISIMNKLIEIIKINNIKLSNLNSD

SEQ ID NO: 3385130 - protein, 24 aa, Plasmodium falciparum
ISINIDFYIRLLVHVIDDALQTKD

SEQ ID NO: 3385131 - protein, 21 aa, Plasmodium falciparum
ISIRQKKTLWRRDDGGYGRYN

SEQ ID NO: 3385132 - protein, 26 aa, Plasmodium falciparum
ISISKFPMTTFMKLLEIMNSKYRCRL

SEQ ID NO: 3385133 - protein, 19 aa, Plasmodium falciparum
ISIYFFVNTILYKNDNLAC

SEQ ID NO: 3385134 - protein, 18 aa, Plasmodium falciparum
ISIYKIFKSWENFIYFFD

SEQ ID NO: 3385135 - protein, 44 aa, Plasmodium falciparum
ISIYQLQVVDLYLRSFFLNYFYFPVYLKTFFFKCRNVKLHIQDY

SEQ ID NO: 3385136 - protein, 34 aa, Plasmodium falciparum
ISKCLMFASYYDPIYIKLFYSYLLPCISFDKRIE

SEQ ID NO: 3385137 - protein, 27 aa, Plasmodium falciparum
ISKDDGCFWIPWKDVIKYFSHIYICWN

SEQ ID NO: 3385138 - protein, 29 aa, Plasmodium falciparum
ISKENCLDMFYVLASYYDIIKNIRENLRK

SEQ ID NO: 3385139 - protein, 37 aa, Plasmodium falciparum
ISKFIKKNEKYDWSGYLPVKIQIMKNTENKKFRILCF

SEQ ID NO: 3385140 - protein, 22 aa, Plasmodium falciparum
ISKHIYKILNISKLPKCDILKR

SEQ ID NO: 3385141 - protein, 22 aa, Plasmodium falciparum
ISKIIDCIGIIYDLLEDVVENG

SEQ ID NO: 3385142 - protein, 19 aa, Plasmodium falciparum
ISKINIQPFDKSNCKKGWN

SEQ ID NO: 3385143 - protein, 24 aa, Plasmodium falciparum
ISKKYDQFYASKKKYKNKLKELER

SEQ ID NO: 3385144 - protein, 27 aa, Plasmodium falciparum
ISKLDDTLYFLLRNNLIKKKITLTGGG

SEQ ID NO: 3385145 - protein, 17 aa, Plasmodium falciparum
ISKNRNYYYPSESKKLT

SEQ ID NO: 3385146 - protein, 23 aa, Plasmodium falciparum
ISKRTVPLVLNKLSKIKLNNTKK

SEQ ID NO: 3385147 - protein, 19 aa, Plasmodium falciparum
ISKVMSLIDKYIYDSNKIN

SEQ ID NO: 3385148 - protein, 26 aa, Plasmodium falciparum
ISLDEQMFLPFPYFTTINNIKNNNIS

SEQ ID NO: 3385149 - protein, 18 aa, Plasmodium falciparum
ISLDSSCSFKWEAHLEKE

SEQ ID NO: 3385150 - protein, 26 aa, Plasmodium falciparum
ISLELNIKLIKWKILKDLKFEHIKKL

SEQ ID NO: 3385151 - protein, 18 aa, Plasmodium falciparum
ISLIKFTYASLYKHIWKN

SEQ ID NO: 3385152 - protein, 25 aa, Plasmodium falciparum
ISLIYDFYFDMKLKKLVKWNVGPFK

SEQ ID NO: 3385153 - protein, 23 aa, Plasmodium falciparum
ISLKYKNLLYQYVYYDKNNKNEN

SEQ ID NO: 3385154 - protein, 21 aa, Plasmodium falciparum
ISLLDIKYEPGFIKNLNLCGK

SEQ ID NO: 3385155 - protein, 28 aa, Plasmodium falciparum
ISLSSKHHLFFTFYSLCKIMVFEDKISK

SEQ ID NO: 3385156 - protein, 19 aa, Plasmodium falciparum
ISLTLNSLLYINDQICIFQ

SEQ ID NO: 3385157 - protein, 29 aa, Plasmodium falciparum
ISLYIHAYTLYWHMRPFAASIIISSFNEK

SEQ ID NO: 3385158 - protein, 22 aa, Plasmodium falciparum
ISMIGQFGVGFYSAYLVADHVV

SEQ ID NO: 3385159 - protein, 31 aa, Plasmodium falciparum
ISMKKSIRFYIEFIALSLLSPKFQYNRNYYK

SEQ ID NO: 3385160 - protein, 24 aa, Plasmodium falciparum
ISMNKHIKLFKEDNIPHIIIGTPG

SEQ ID NO: 3385161 - protein, 21 aa, Plasmodium falciparum
ISNIKEYYLDGINIFEVINYV

SEQ ID NO: 3385162 - protein, 18 aa, Plasmodium falciparum
ISNKDISFFLNPLSHYSP

SEQ ID NO: 3385163 - protein, 24 aa, Plasmodium falciparum
ISNLFVDIFLNHKIVKLAGAYALD

SEQ ID NO: 3385164 - protein, 22 aa, Plasmodium falciparum
ISNMEGSLKWKLSSREKENYQR

SEQ ID NO: 3385165 - protein, 26 aa, Plasmodium falciparum
ISNNFVLARYTFPFSQLLQIIQKDKH

SEQ ID NO: 3385166 - protein, 22 aa, Plasmodium falciparum
ISNNIYNTFIPISSNDIMNNNI

SEQ ID NO: 3385167 - protein, 25 aa, Plasmodium falciparum
ISNSTYLVHLLPTIIFTLLHVVTQI

SEQ ID NO: 3385168 - protein, 17 aa, Plasmodium falciparum
ISNYLKYVNMPNGSNSL

SEQ ID NO: 3385169 - protein, 24 aa, Plasmodium falciparum
ISPRNYFTFTPLLPCLCSGTLSVN

SEQ ID NO: 3385170 - protein, 34 aa, Plasmodium falciparum
ISQESKIYSFYYKFYNILILIKKMKSNKKLGIDL

SEQ ID NO: 3385171 - protein, 28 aa, Plasmodium falciparum
ISQFFDEYDMWKCFLSNIYRYENEKCDK

SEQ ID NO: 3385172 - protein, 18 aa, Plasmodium falciparum
ISQIFVFGYSYESVLVCV

SEQ ID NO: 3385173 - protein, 34 aa, Plasmodium falciparum
ISREYIKTMRRLSNKFLIKYDSKFKKLFCKKCNS

SEQ ID NO: 3385174 - protein, 22 aa, Plasmodium falciparum
ISRFLLYINRRRRKLRSKILFN

SEQ ID NO: 3385175 - protein, 25 aa, Plasmodium falciparum
ISSDDIIFYSYLKDYSYNVIINKIV

SEQ ID NO: 3385176 - protein, 38 aa, Plasmodium falciparum
ISSEKMNFNLWPTRVNILKAVNWLVRDSIPFGSYVFYF

SEQ ID NO: 3385177 - protein, 46 aa, Plasmodium falciparum
ISSKINEILFTFPYANFLLSKYFSNFLLFIQLFRTSLDVDHMYLCK

SEQ ID NO: 3385178 - protein, 23 aa, Plasmodium falciparum
ISSNDNFFSVYGKSIRSSSFSNN

SEQ ID NO: 3385179 - protein, 25 aa, Plasmodium falciparum
ISSNELLYALRFLGVESDYSLMENK

SEQ ID NO: 3385180 - protein, 32 aa, Plasmodium falciparum
ISSQFFMHKVKFLPWEYLNSSLSLIFVVQSKD

SEQ ID NO: 3385181 - protein, 32 aa, Plasmodium falciparum
ISSSYNQHFFPNLNFLLNLHTLQILIRDKTAI

SEQ ID NO: 3385182 - protein, 22 aa, Plasmodium falciparum
ISTIFNIVFSDYIFEAKKNFIE

SEQ ID NO: 3385183 - protein, 24 aa, Plasmodium falciparum
ISTKKNILSGAKEKPVAWPSNLCN

SEQ ID NO: 3385184 - protein, 23 aa, Plasmodium falciparum
ISTSPILNKKFVYVKNNYIFQKR

SEQ ID NO: 3385185 - protein, 23 aa, Plasmodium falciparum
ISTYFNCAPIFYVPGRKYNVDIY

SEQ ID NO: 3385186 - protein, 25 aa, Plasmodium falciparum
ISVDVPVPYMVPKPVVVNVEVPVLK

SEQ ID NO: 3385187 - protein, 27 aa, Plasmodium falciparum
ISVSHEKLLLLKKKKRYFLGLKECYKH

SEQ ID NO: 3385188 - protein, 22 aa, Plasmodium falciparum
ISYDMNKLYKGTRLSYKEKHQT

SEQ ID NO: 3385189 - protein, 20 aa, Plasmodium falciparum
ISYEYFYKDTYINEHEHTKI

SEQ ID NO: 3385190 - protein, 32 aa, Plasmodium falciparum
ISYIAVDMAIYWNKFLYMNPCFTKKKKTKTKK

SEQ ID NO: 3385191 - protein, 30 aa, Plasmodium falciparum
ISYILKNIKNPNMFNMLFKKKSNNNLLDIK

SEQ ID NO: 3385192 - protein, 19 aa, Plasmodium falciparum
ISYISVMSPTNEVLKEKNT

SEQ ID NO: 3385193 - protein, 24 aa, Plasmodium falciparum
ISYKYLEHLKYSKILVYMFDINND

SEQ ID NO: 3385194 - protein, 20 aa, Plasmodium falciparum
ISYTYPDGSVWCCEGHISRL

SEQ ID NO: 3385195 - protein, 24 aa, Plasmodium falciparum
ITAEGQVMFTFLGRSEIKDYKNVK

SEQ ID NO: 3385196 - protein, 21 aa, Plasmodium falciparum
ITASLAWTLKYKKIKEKSIFG

SEQ ID NO: 3385197 - protein, 35 aa, Plasmodium falciparum
ITCLKSSLKMMYAYCLFKNLKLFYQIQYKNMNMTE

SEQ ID NO: 3385198 - protein, 17 aa, Plasmodium falciparum
ITCLLYISFHRINNFLN

SEQ ID NO: 3385199 - protein, 25 aa, Plasmodium falciparum
ITCVKWYQEFFILSGSRNCSYIYLY

SEQ ID NO: 3385200 - protein, 22 aa, Plasmodium falciparum
ITDENPFFYTLIVSSKRDENRS

SEQ ID NO: 3385201 - protein, 27 aa, Plasmodium falciparum
ITDGSFVREIKLINLLLNGNVPDEYIF

SEQ ID NO: 3385202 - protein, 27 aa, Plasmodium falciparum
ITDINALQPIFIKSTWPLAKYSILQFS

SEQ ID NO: 3385203 - protein, 30 aa, Plasmodium falciparum
ITDKPAMELIPTINVLHPYANNFNGNVCNT

SEQ ID NO: 3385204 - protein, 23 aa, Plasmodium falciparum
ITDRYIKFISLSSSTFSLNIPYC

SEQ ID NO: 3385205 - protein, 18 aa, Plasmodium falciparum
ITECLIPIFWENNKIKIK

SEQ ID NO: 3385206 - protein, 36 aa, Plasmodium falciparum
ITEEEQLLIINRLHSVLLPFMLRRVKKDVLKSLPKK

SEQ ID NO: 3385207 - protein, 24 aa, Plasmodium falciparum
ITEEKINWLQNLKFKKDSINQQIL

SEQ ID NO: 3385208 - protein, 30 aa, Plasmodium falciparum
ITEKDKFRLYRSLLKFGNPSLRLDDIQEDA

SEQ ID NO: 3385209 - protein, 28 aa, Plasmodium falciparum
ITEKKKLLFFLYLFSKNYYHLSNDNSEW

SEQ ID NO: 3385210 - protein, 29 aa, Plasmodium falciparum
ITELDTFWNAHSFFLFIKGKFQDSFEAKI

SEQ ID NO: 3385211 - protein, 24 aa, Plasmodium falciparum
ITFQEYYMAIHNLNRYIDESKCYD

SEQ ID NO: 3385212 - protein, 26 aa, Plasmodium falciparum
ITFSRNNIMLLKRILEKYNKRVFVIY

SEQ ID NO: 3385213 - protein, 32 aa, Plasmodium falciparum
ITGVSYDRKQKIWVSHWRANCKTIHKYFSVKK

SEQ ID NO: 3385214 - protein, 25 aa, Plasmodium falciparum
ITHPKMRRYIKNPRILLLDCTLEYK

SEQ ID NO: 3385215 - protein, 25 aa, Plasmodium falciparum
ITIADIFISVILYFSLNSGALNESI

SEQ ID NO: 3385216 - protein, 54 aa, Plasmodium falciparum
ITIHAYNTVVPSLWLYASISFYLTKFHLENFKLKTPCHFTLAQNTDFLNSITNN

SEQ ID NO: 3385217 - protein, 24 aa, Plasmodium falciparum
ITIKDILTLKCFIKKPFHDKITLS

SEQ ID NO: 3385218 - protein, 18 aa, Plasmodium falciparum
ITIKQILLGIQDLLDNPN

SEQ ID NO: 3385219 - protein, 17 aa, Plasmodium falciparum
ITILLRGGNQMMIEECE

SEQ ID NO: 3385220 - protein, 28 aa, Plasmodium falciparum
ITINYITKRFPFLKNVILVKSNFKCINE

SEQ ID NO: 3385221 - protein, 25 aa, Plasmodium falciparum
ITKENLMVMNKWYKGIYIVAIVKNI

SEQ ID NO: 3385222 - protein, 25 aa, Plasmodium falciparum
ITKKNFNFFGSFYSKYAKRNKNDKS

SEQ ID NO: 3385223 - protein, 27 aa, Plasmodium falciparum
ITKLDNWKVHFLYKIKSKLSVEPNVEL

SEQ ID NO: 3385224 - protein, 17 aa, Plasmodium falciparum
ITKLLKKMDNIYLGYNE

SEQ ID NO: 3385225 - protein, 23 aa, Plasmodium falciparum
ITKNIFLEILFLLSPHENINECV

SEQ ID NO: 3385226 - protein, 28 aa, Plasmodium falciparum
ITKSKVEFLCYKLIYMTLQNMHQEFLIE

SEQ ID NO: 3385227 - protein, 25 aa, Plasmodium falciparum
ITKSTIYLDIHHLKNTLLYKVSTKD

SEQ ID NO: 3385228 - protein, 31 aa, Plasmodium falciparum
ITKTQNELFSLKLPLEIKVSMALRISERLRA

SEQ ID NO: 3385229 - protein, 24 aa, Plasmodium falciparum
ITKYINEQFSLSKIQFENKMNEYV

SEQ ID NO: 3385230 - protein, 18 aa, Plasmodium falciparum
ITLIFLKEELAFWSIVQL

SEQ ID NO: 3385231 - protein, 17 aa, Plasmodium falciparum
ITLITSGYYKKGLYEFL

SEQ ID NO: 3385232 - protein, 39 aa, Plasmodium falciparum
ITLKEREYPLKSFPWPNAKCPMFFYNSTGLEEMSASGTS

SEQ ID NO: 3385233 - protein, 18 aa, Plasmodium falciparum
ITLLAILIAPFMTPLYRF

SEQ ID NO: 3385234 - protein, 19 aa, Plasmodium falciparum
ITLVRATLLPILSIGKNEK

SEQ ID NO: 3385235 - protein, 19 aa, Plasmodium falciparum
ITLYKNGFIVDDGEFRDLE

SEQ ID NO: 3385236 - protein, 29 aa, Plasmodium falciparum
ITNEDILNTPLFVEPIFNDKHNVSNDLFQ

SEQ ID NO: 3385237 - protein, 18 aa, Plasmodium falciparum
ITNGNEYRYINNKLYTLV

SEQ ID NO: 3385238 - protein, 28 aa, Plasmodium falciparum
ITNIECIYIRCYLCNSLNYSKYSPFNIN

SEQ ID NO: 3385239 - protein, 25 aa, Plasmodium falciparum
ITNIVNDILLVKNVYEDLIKEKDMH

SEQ ID NO: 3385240 - protein, 17 aa, Plasmodium falciparum
ITNQGVQTLLLQKQVIS

SEQ ID NO: 3385241 - protein, 21 aa, Plasmodium falciparum
ITNRHPFPGPGLAIRVIGEIN

SEQ ID NO: 3385242 - protein, 17 aa, Plasmodium falciparum
ITNVKKSILIKNTKKRD

SEQ ID NO: 3385243 - protein, 24 aa, Plasmodium falciparum
ITNVLIILHTFLKKYFIKRNIHIN

SEQ ID NO: 3385244 - protein, 17 aa, Plasmodium falciparum
ITNYNLIIPKELKYDLL

SEQ ID NO: 3385245 - protein, 27 aa, Plasmodium falciparum
ITQKKPSIFIKPLSNSPKTLSKIPYSK

SEQ ID NO: 3385246 - protein, 24 aa, Plasmodium falciparum
ITQYQKIMYLLNVKNKQNAYLLDL

SEQ ID NO: 3385247 - protein, 28 aa, Plasmodium falciparum
ITSLAKQTILLLLKDILNSIPHQMAPSI

SEQ ID NO: 3385248 - protein, 27 aa, Plasmodium falciparum
ITTLLQEIVSIYPQLSPPLLTTSSSNR

SEQ ID NO: 3385249 - protein, 27 aa, Plasmodium falciparum
ITTTLSYPLVNSNFVHLYPYQNSNTNN

SEQ ID NO: 3385250 - protein, 37 aa, Plasmodium falciparum
ITVSEMLTNLFNFRYKRNITIAYDYVESLIGFYQDKY

SEQ ID NO: 3385251 - protein, 24 aa, Plasmodium falciparum
IVASMLNIAILIFDVAKHEGVDSN

SEQ ID NO: 3385252 - protein, 20 aa, Plasmodium falciparum
IVDFFAEWCGPCKRIAPFYE

SEQ ID NO: 3385253 - protein, 24 aa, Plasmodium falciparum
IVDINYSYIFPKIDKRKFLNLIDE

SEQ ID NO: 3385254 - protein, 19 aa, Plasmodium falciparum
IVDLKFKNPFINEEKKRKL

SEQ ID NO: 3385255 - protein, 19 aa, Plasmodium falciparum
IVDQTNIFYLWGEDIKNSI

SEQ ID NO: 3385256 - protein, 30 aa, Plasmodium falciparum
IVDSPITKNYYLYINNFYDFVYNYNNNNII

SEQ ID NO: 3385257 - protein, 25 aa, Plasmodium falciparum
IVEELMKFLPKEKQILMYSATFPVT

SEQ ID NO: 3385258 - protein, 20 aa, Plasmodium falciparum
IVEHLLGRQVALSLASGFLL

SEQ ID NO: 3385259 - protein, 30 aa, Plasmodium falciparum
IVEIGDIFDYLHKLILLCQTKIKYYEQAYK

SEQ ID NO: 3385260 - protein, 18 aa, Plasmodium falciparum
IVEKLIFHMKNSVDIHFK

SEQ ID NO: 3385261 - protein, 19 aa, Plasmodium falciparum
IVFFPTCLCVEFFFHLFKN

SEQ ID NO: 3385262 - protein, 18 aa, Plasmodium falciparum
IVFPKNRVNKFSTSVRSL

SEQ ID NO: 3385263 - protein, 18 aa, Plasmodium falciparum
IVFTYFNENFRAHNSFVI

SEQ ID NO: 3385264 - protein, 17 aa, Plasmodium falciparum
IVFVNLLCELVGVNLYL

SEQ ID NO: 3385265 - protein, 25 aa, Plasmodium falciparum
IVIDKLYYIMCKWKNILENYAMDLL

SEQ ID NO: 3385266 - protein, 18 aa, Plasmodium falciparum
IVIIKGLELLYSLGALND

SEQ ID NO: 3385267 - protein, 18 aa, Plasmodium falciparum
IVIKKKITYNKEKEVKNI

SEQ ID NO: 3385268 - protein, 17 aa, Plasmodium falciparum
IVILIQLCEYGVSPKIL

SEQ ID NO: 3385269 - protein, 17 aa, Plasmodium falciparum
IVIVFNFEKEYIDSEVT

SEQ ID NO: 3385270 - protein, 19 aa, Plasmodium falciparum
IVIVQNFYKDINKGIIQLI

SEQ ID NO: 3385271 - protein, 39 aa, Plasmodium falciparum
IVKCAYASDKFTLFLTIEGILYGVGLINEHLLKGDMNKD

SEQ ID NO: 3385272 - protein, 42 aa, Plasmodium falciparum
IVKHTYMYINILISFFDKLNEWILVCLLKKFLQNFKSSKQLS

SEQ ID NO: 3385273 - protein, 17 aa, Plasmodium falciparum
IVKKALGIIILIHGLAS

SEQ ID NO: 3385274 - protein, 17 aa, Plasmodium falciparum
IVKKLVNMVFPKEIIDT

SEQ ID NO: 3385275 - protein, 31 aa, Plasmodium falciparum
IVKKNEEILILLYKIIYKLNIFDINKKFNKK

SEQ ID NO: 3385276 - protein, 19 aa, Plasmodium falciparum
IVKLFFEISSCLYYIHKKN

SEQ ID NO: 3385277 - protein, 18 aa, Plasmodium falciparum
IVKMYKRKLSFGKDNKKE

SEQ ID NO: 3385278 - protein, 17 aa, Plasmodium falciparum
IVLFETYDEIILSGVGK

SEQ ID NO: 3385279 - protein, 48 aa, Plasmodium falciparum
IVLKIPSSILIINIQEFNCCICKIYLSYQPILFPCCFVSSCSDCLANY

SEQ ID NO: 3385280 - protein, 22 aa, Plasmodium falciparum
IVLKNILNVYFLFDKNNQGFID

SEQ ID NO: 3385281 - protein, 17 aa, Plasmodium falciparum
IVLLKEGTDTAQGRSQI

SEQ ID NO: 3385282 - protein, 21 aa, Plasmodium falciparum
IVNIFQIYSYLYYYNKKKEMI

SEQ ID NO: 3385283 - protein, 29 aa, Plasmodium falciparum
IVNSRPFRRGGFRPRFYRGFRGGRGGFLR

SEQ ID NO: 3385284 - protein, 18 aa, Plasmodium falciparum
IVNYLNRLTDLSIDHNVE

SEQ ID NO: 3385285 - protein, 25 aa, Plasmodium falciparum
IVQAEWDIIFKKLNLIKDCGANIVL

SEQ ID NO: 3385286 - protein, 17 aa, Plasmodium falciparum
IVQKILIDELGLNYICA

SEQ ID NO: 3385287 - protein, 28 aa, Plasmodium falciparum
IVQKLLHIHMYYYFINGNGLENSLKYSF

SEQ ID NO: 3385288 - protein, 25 aa, Plasmodium falciparum
IVQSKLELFSYNKILSLLRKYEYEE

SEQ ID NO: 3385289 - protein, 24 aa, Plasmodium falciparum
IVRDSVLFTYRILSNLFKDLSLNY

SEQ ID NO: 3385290 - protein, 29 aa, Plasmodium falciparum
IVSKDVGFFNLYILDKNYKYNYHTYTKQT

SEQ ID NO: 3385291 - protein, 20 aa, Plasmodium falciparum
IVSKILYMNKKRSRIKIICM

SEQ ID NO: 3385292 - protein, 34 aa, Plasmodium falciparum
IVSLNDMWIFSFDSILWIRINYLCDDIPMGRFGM

SEQ ID NO: 3385293 - protein, 32 aa, Plasmodium falciparum
IVSPGNDIWACGVILYVLMDGRFPYEINNYMP

SEQ ID NO: 3385294 - protein, 17 aa, Plasmodium falciparum
IVSSQTMLPFSYIGLNL

SEQ ID NO: 3385295 - protein, 28 aa, Plasmodium falciparum
IVSTDEVFVYFFSQKKWYLLKGKLCNDE

SEQ ID NO: 3385296 - protein, 23 aa, Plasmodium falciparum
IVSYIPEYDLFSNRRKSNAKLCI

SEQ ID NO: 3385297 - protein, 35 aa, Plasmodium falciparum
IVTNVSGATWIYAPPELLTCHPLKQSSDYNFLDHT

SEQ ID NO: 3385298 - protein, 36 aa, Plasmodium falciparum
IVTPTNKVLILLKNKTVFILTIKERQYYLHGIQLLR

SEQ ID NO: 3385299 - protein, 21 aa, Plasmodium falciparum
IVVKHHLTMYIDVIEKLKNEI

SEQ ID NO: 3385300 - protein, 26 aa, Plasmodium falciparum
IVYEANLPFILRYIIDHKITGSSWIN

SEQ ID NO: 3385301 - protein, 50 aa, Plasmodium falciparum
IWEDNEFYLKLKNADYIRSFYFYDNSWTRPFMSLLVHKVLDDNLNLLPFY

SEQ ID NO: 3385302 - protein, 17 aa, Plasmodium falciparum
IWEESIIMLPHHVQILL

SEQ ID NO: 3385303 - protein, 28 aa, Plasmodium falciparum
IWEIKNMQINWYTLFNLSNEINNQNVHY

SEQ ID NO: 3385304 - protein, 20 aa, Plasmodium falciparum
IWKGILSMKNKENLNIIGHA

SEQ ID NO: 3385305 - protein, 18 aa, Plasmodium falciparum
IWLHTIIVIYKCVHILKS

SEQ ID NO: 3385306 - protein, 31 aa, Plasmodium falciparum
IWNDKRYITNGNIAAPFFVNNNDMILSPHYN

SEQ ID NO: 3385307 - protein, 21 aa, Plasmodium falciparum
IWRYTHLLHHFIGENGLILPR

SEQ ID NO: 3385308 - protein, 27 aa, Plasmodium falciparum
IWSDKHLFEYLLNPKLYIPGTKMIFAG

SEQ ID NO: 3385309 - protein, 36 aa, Plasmodium falciparum
IWSYDGNSFLLLHSIEGLLLISNYEEKKKRKIEKIA

SEQ ID NO: 3385310 - protein, 20 aa, Plasmodium falciparum
IYAKIEHPIIFITCGSYNSA

SEQ ID NO: 3385311 - protein, 22 aa, Plasmodium falciparum
IYALFEHLKKQNQFPLLICLDQ

SEQ ID NO: 3385312 - protein, 18 aa, Plasmodium falciparum
IYALIVRNPNIFIDHIYC

SEQ ID NO: 3385313 - protein, 34 aa, Plasmodium falciparum
IYATNSSFPPYKFISYLRPKLTPKAYHLKNNEIL

SEQ ID NO: 3385314 - protein, 18 aa, Plasmodium falciparum
IYAYCYLHRIYNKSINNK

SEQ ID NO: 3385315 - protein, 17 aa, Plasmodium falciparum
IYCDKANNIYYYGNNYK

SEQ ID NO: 3385316 - protein, 30 aa, Plasmodium falciparum
IYDCDNSLVSIINKIKKLYKCYRSMEEKYL

SEQ ID NO: 3385317 - protein, 22 aa, Plasmodium falciparum
IYDHKLVPSIIFLLNTTLQTNG

SEQ ID NO: 3385318 - protein, 18 aa, Plasmodium falciparum
IYDILLCYNNMRNLNKED

SEQ ID NO: 3385319 - protein, 24 aa, Plasmodium falciparum
IYDKIHIVLYDYLGLMVCHISFPE

SEQ ID NO: 3385320 - protein, 20 aa, Plasmodium falciparum
IYDLHEIKILSPHILKTLFQ

SEQ ID NO: 3385321 - protein, 18 aa, Plasmodium falciparum
IYDNNVMNFLLNLKTQKV

SEQ ID NO: 3385322 - protein, 34 aa, Plasmodium falciparum
IYDQNKMKLYDYLQKLLLENYFLETKMKLKNESL

SEQ ID NO: 3385323 - protein, 21 aa, Plasmodium falciparum
IYDSIYIPQINIKNIINSEEI

SEQ ID NO: 3385324 - protein, 33 aa, Plasmodium falciparum
IYDSRFSIIYLEHDLIYLKKNNLKVILNVLLSN

SEQ ID NO: 3385325 - protein, 19 aa, Plasmodium falciparum
IYDYNYMENFDYFLKKKKK

SEQ ID NO: 3385326 - protein, 19 aa, Plasmodium falciparum
IYEHLNGFVFFDFINGIKE

SEQ ID NO: 3385327 - protein, 18 aa, Plasmodium falciparum
IYEILLSLFEKKYQSKYD

SEQ ID NO: 3385328 - protein, 20 aa, Plasmodium falciparum
IYEKIDLTLLNRLLRLIVDH

SEQ ID NO: 3385329 - protein, 17 aa, Plasmodium falciparum
IYEKIKSDPIWGLYEIM

SEQ ID NO: 3385330 - protein, 25 aa, Plasmodium falciparum
IYELKIYPYKMKWLPTYATPNNTQA

SEQ ID NO: 3385331 - protein, 20 aa, Plasmodium falciparum
IYELPLHIIVPLEHENILKI

SEQ ID NO: 3385332 - protein, 18 aa, Plasmodium falciparum
IYESVVFLSAENLYVLKN

SEQ ID NO: 3385333 - protein, 27 aa, Plasmodium falciparum
IYETNILEELFILNKKKKKFVGENEAW

SEQ ID NO: 3385334 - protein, 20 aa, Plasmodium falciparum
IYEYLNTPYYDYFDLYVKTL

SEQ ID NO: 3385335 - protein, 19 aa, Plasmodium falciparum
IYFCCLNERFGGCGSVLSL

SEQ ID NO: 3385336 - protein, 24 aa, Plasmodium falciparum
IYFENECLRYLYSAQFDFSKAMEL

SEQ ID NO: 3385337 - protein, 19 aa, Plasmodium falciparum
IYFLNHIYNFIKKNKYYGN

SEQ ID NO: 3385338 - protein, 20 aa, Plasmodium falciparum
IYFLSSWKIKTAILKTIIAF

SEQ ID NO: 3385339 - protein, 34 aa, Plasmodium falciparum
IYFSFHDLYISPMRLYYFIKMKIDEIYYLDMSRK

SEQ ID NO: 3385340 - protein, 21 aa, Plasmodium falciparum
IYGMKAMASVWNRGPLSVTKF

SEQ ID NO: 3385341 - protein, 19 aa, Plasmodium falciparum
IYHDNKVTWLAYYKDSIND

SEQ ID NO: 3385342 - protein, 25 aa, Plasmodium falciparum
IYHNKLYIFDILTSYNIATIDLLHY

SEQ ID NO: 3385343 - protein, 18 aa, Plasmodium falciparum
IYIFYQLIYLKNNNKYIF

SEQ ID NO: 3385344 - protein, 18 aa, Plasmodium falciparum
IYIGVILNFITKNNNVVS

SEQ ID NO: 3385345 - protein, 20 aa, Plasmodium falciparum
IYIHPNDNLTFYRPSINKEN

SEQ ID NO: 3385346 - protein, 29 aa, Plasmodium falciparum
IYIHPNVPCKFGIYCTNYYCNYSHDHVDT

SEQ ID NO: 3385347 - protein, 20 aa, Plasmodium falciparum
IYIIDLYYIDYNYKFMIYTF

SEQ ID NO: 3385348 - protein, 20 aa, Plasmodium falciparum
IYIIIEIIYAYCYLHRIYNK

SEQ ID NO: 3385349 - protein, 22 aa, Plasmodium falciparum
IYINNNILYLCINDLTKLRLIN

SEQ ID NO: 3385350 - protein, 21 aa, Plasmodium falciparum
IYITKHFLYTQIKKAHKLVTL

SEQ ID NO: 3385351 - protein, 19 aa, Plasmodium falciparum
IYITPKLYLESIKTYHIML

SEQ ID NO: 3385352 - protein, 32 aa, Plasmodium falciparum
IYITTSYFLPPGFLRRALFSALYKGVNISFLF

SEQ ID NO: 3385353 - protein, 21 aa, Plasmodium falciparum
IYIWDKYTNKYLFHFKKHKAA

SEQ ID NO: 3385354 - protein, 25 aa, Plasmodium falciparum
IYKDNYSFIYFIFLHNINEHVEITT

SEQ ID NO: 3385355 - protein, 20 aa, Plasmodium falciparum
IYKFIKKKCIQKKKAMPWIQ

SEQ ID NO: 3385356 - protein, 20 aa, Plasmodium falciparum
IYKHYILRDLIRILRVSHSI

SEQ ID NO: 3385357 - protein, 19 aa, Plasmodium falciparum
IYKKLQKKIVFNNKILLTG

SEQ ID NO: 3385358 - protein, 25 aa, Plasmodium falciparum
IYKNDIYINDIYKKDIYKNDIYKND

SEQ ID NO: 3385359 - protein, 17 aa, Plasmodium falciparum
IYKNFSANLIEPSYFIN

SEQ ID NO: 3385360 - protein, 34 aa, Plasmodium falciparum
IYKNSLYLFGYSYLYTPLFFNNKNSIIKYVKACI

SEQ ID NO: 3385361 - protein, 24 aa, Plasmodium falciparum
IYKNTYFQLNIGKPTYYLNVNKNI

SEQ ID NO: 3385362 - protein, 25 aa, Plasmodium falciparum
IYKQGNMYMHIPKNADLMNNVSSYS

SEQ ID NO: 3385363 - protein, 20 aa, Plasmodium falciparum
IYKYHPKCSLILRINVDFKN

SEQ ID NO: 3385364 - protein, 27 aa, Plasmodium falciparum
IYKYPIKYCELNSKAFVFFIIKNVGVH

SEQ ID NO: 3385365 - protein, 17 aa, Plasmodium falciparum
IYLAKKYLKDMGIESSD

SEQ ID NO: 3385366 - protein, 29 aa, Plasmodium falciparum
IYLAKRYFRLYWIIVYHIEIPKKINIAYP

SEQ ID NO: 3385367 - protein, 20 aa, Plasmodium falciparum
IYLDLTHLPYETLKERLPGI

SEQ ID NO: 3385368 - protein, 39 aa, Plasmodium falciparum
IYLFDKYIVIRYYDLFKYCILLIFLLNNQLICVLENGYI

SEQ ID NO: 3385369 - protein, 19 aa, Plasmodium falciparum
IYLIGENNFIFLLKKGNHV

SEQ ID NO: 3385370 - protein, 20 aa, Plasmodium falciparum
IYLLNLYTPMMQKLNTIMNT

SEQ ID NO: 3385371 - protein, 18 aa, Plasmodium falciparum
IYLNDLRKHDLAHIWCFL

SEQ ID NO: 3385372 - protein, 19 aa, Plasmodium falciparum
IYLPLSVLGFVHIEVKSNN

SEQ ID NO: 3385373 - protein, 18 aa, Plasmodium falciparum
IYLRRIKPLFCYSNMIDR

SEQ ID NO: 3385374 - protein, 24 aa, Plasmodium falciparum
IYNDHYIFVYIIKDYNIYERLKYK

SEQ ID NO: 3385375 - protein, 25 aa, Plasmodium falciparum
IYNDYIYIYCKEGIKIYGIIENYII

SEQ ID NO: 3385376 - protein, 23 aa, Plasmodium falciparum
IYNDYLVLQLIRKSFDKDDESQM

SEQ ID NO: 3385377 - protein, 29 aa, Plasmodium falciparum
IYNERVEIKFRFLFSLSPITCIKFIPRHS

SEQ ID NO: 3385378 - protein, 26 aa, Plasmodium falciparum
IYNFYKHFRLFKMFQIYNLSHIEKIK

SEQ ID NO: 3385379 - protein, 19 aa, Plasmodium falciparum
IYNGLIQIIRCYKKFAPHR

SEQ ID NO: 3385380 - protein, 18 aa, Plasmodium falciparum
IYNINMYLYLLNKYDYKC

SEQ ID NO: 3385381 - protein, 26 aa, Plasmodium falciparum
IYNKFYRHFIIHYLPQIRSLDFHDIS

SEQ ID NO: 3385382 - protein, 23 aa, Plasmodium falciparum
IYNKGLGQFYAGFYAKLIESGSK

SEQ ID NO: 3385383 - protein, 24 aa, Plasmodium falciparum
IYNLNMHDYFYKSLKSNIMMEPEL

SEQ ID NO: 3385384 - protein, 27 aa, Plasmodium falciparum
IYNNSLWVYRYFILNKLSYFHDLAKMQ

SEQ ID NO: 3385385 - protein, 22 aa, Plasmodium falciparum
IYNQFCTTYIAIIFIYKEDSMH

SEQ ID NO: 3385386 - protein, 17 aa, Plasmodium falciparum
IYNVNPLSNYIKNDKES

SEQ ID NO: 3385387 - protein, 20 aa, Plasmodium falciparum
IYNYKFPSWIPKRSINNFFI

SEQ ID NO: 3385388 - protein, 17 aa, Plasmodium falciparum
IYPLKRLKVYNEPNSIE

SEQ ID NO: 3385389 - protein, 17 aa, Plasmodium falciparum
IYPLNILKKKSFNVTDR

SEQ ID NO: 3385390 - protein, 19 aa, Plasmodium falciparum
IYPNDKFIKPLFSFDKEKV

SEQ ID NO: 3385391 - protein, 19 aa, Plasmodium falciparum
IYQLVTCTVPFDGSTEWFI

SEQ ID NO: 3385392 - protein, 25 aa, Plasmodium falciparum
IYQQYNMTVTYPYGVPYINMKNKIT

SEQ ID NO: 3385393 - protein, 18 aa, Plasmodium falciparum
IYRDIDIFFSLEHKTKNL

SEQ ID NO: 3385394 - protein, 25 aa, Plasmodium falciparum
IYRGYIVHLFFNESLIFNSVRLFTK

SEQ ID NO: 3385395 - protein, 17 aa, Plasmodium falciparum
IYRIIHSDKVQASLLAK

SEQ ID NO: 3385396 - protein, 26 aa, Plasmodium falciparum
IYRLPNLYMIIYIKRFKWIYDQRTNY

SEQ ID NO: 3385397 - protein, 34 aa, Plasmodium falciparum
IYRSEYRVVVKHFPRFFKNIKEFLSRAGKVLYIH

SEQ ID NO: 3385398 - protein, 28 aa, Plasmodium falciparum
IYSDLFKVLFYELQPHYKIYIPSSNNKI

SEQ ID NO: 3385399 - protein, 24 aa, Plasmodium falciparum
IYSKQILQTALIQITYKQNVNQMK

SEQ ID NO: 3385400 - protein, 21 aa, Plasmodium falciparum
IYSKWSPYIPDLFASSTNMDT

SEQ ID NO: 3385401 - protein, 17 aa, Plasmodium falciparum
IYSLPKKNKPRCLVISD

SEQ ID NO: 3385402 - protein, 29 aa, Plasmodium falciparum
IYSNCYFSCMFWFSYYLYNYEKSLEEVLN

SEQ ID NO: 3385403 - protein, 24 aa, Plasmodium falciparum
IYSNKPPLHPKKDHWFFGPKEDFK

SEQ ID NO: 3385404 - protein, 23 aa, Plasmodium falciparum
IYSNNFMHIYDTEALFSNNTEKE

SEQ ID NO: 3385405 - protein, 22 aa, Plasmodium falciparum
IYSPNPMLDIFSPKPQINHNIY

SEQ ID NO: 3385406 - protein, 30 aa, Plasmodium falciparum
IYSQYKNTIKWGPFGNMIALGGFGNLAGDI

SEQ ID NO: 3385407 - protein, 18 aa, Plasmodium falciparum
IYSWGGFTDIPFDHNFFP

SEQ ID NO: 3385408 - protein, 25 aa, Plasmodium falciparum
IYTCEWPSLFIEWLPKVYKNDEEYA

SEQ ID NO: 3385409 - protein, 21 aa, Plasmodium falciparum
IYTIIHIFCKLKFTKYSLYNN

SEQ ID NO: 3385410 - protein, 17 aa, Plasmodium falciparum
IYTPKLINKKEALVINS

SEQ ID NO: 3385411 - protein, 26 aa, Plasmodium falciparum
IYTTNMKMPKYNFSTPINIYNDYINR

SEQ ID NO: 3385412 - protein, 19 aa, Plasmodium falciparum
IYTVLYRMLIKKINERNKI

SEQ ID NO: 3385413 - protein, 21 aa, Plasmodium falciparum
IYTYYKKYYESLFAKINIDKT

SEQ ID NO: 3385414 - protein, 17 aa, Plasmodium falciparum
IYVLKDRISYLKEKTNI

SEQ ID NO: 3385415 - protein, 17 aa, Plasmodium falciparum
IYVLSNFSIYLAFYNYT

SEQ ID NO: 3385416 - protein, 36 aa, Plasmodium falciparum
IYVQTELYIDIISSSIRNLINFKKTLEERNVELEKV

SEQ ID NO: 3385417 - protein, 20 aa, Plasmodium falciparum
IYYDFDDLLIETYRLMKDNA

SEQ ID NO: 3385418 - protein, 25 aa, Plasmodium falciparum
KAAHDAYMLLAIGNAAWPMGVTMVG

SEQ ID NO: 3385419 - protein, 24 aa, Plasmodium falciparum
KACLKCFAKQDIIYSWGGFTDIPF

SEQ ID NO: 3385420 - protein, 34 aa, Plasmodium falciparum
KACVCYIKNNDNYICFFCLYDINFCTLCKEVLTN

SEQ ID NO: 3385421 - protein, 20 aa, Plasmodium falciparum
KADINYLDKIGRSALHYACA

SEQ ID NO: 3385422 - protein, 20 aa, Plasmodium falciparum
KAEAFVHWLINEYSMENTNG

SEQ ID NO: 3385423 - protein, 25 aa, Plasmodium falciparum
KAEKDDFFFYDTKKGIWYEIISDEY

SEQ ID NO: 3385424 - protein, 25 aa, Plasmodium falciparum
KAENPKAYVFALHGITSHLRNEYLN

SEQ ID NO: 3385425 - protein, 30 aa, Plasmodium falciparum
KAETFDVPPYCELAPLIVLTKNCQLSTFEN

SEQ ID NO: 3385426 - protein, 21 aa, Plasmodium falciparum
KAFLINLKNLEYKILTFQIDE

SEQ ID NO: 3385427 - protein, 19 aa, Plasmodium falciparum
KAHIVGIDIFTGRKYEDIC

SEQ ID NO: 3385428 - protein, 25 aa, Plasmodium falciparum
KAHKSLYIIIINFTRQTLNLTDCRG

SEQ ID NO: 3385429 - protein, 17 aa, Plasmodium falciparum
KAILMKKIPAKYKMNTV

SEQ ID NO: 3385430 - protein, 29 aa, Plasmodium falciparum
KAISFLIYEQCFIEYLYEGKYFAALRCLR

SEQ ID NO: 3385431 - protein, 17 aa, Plasmodium falciparum
KAIVLFETYDEIILSGV

SEQ ID NO: 3385432 - protein, 17 aa, Plasmodium falciparum
KAIYWKNMSYLSQNKYT

SEQ ID NO: 3385433 - protein, 28 aa, Plasmodium falciparum
KAKELLLILKYIFHLNVDYDKYIFNHIY

SEQ ID NO: 3385434 - protein, 20 aa, Plasmodium falciparum
KAKIHLDNKIYRGKILIAKY

SEQ ID NO: 3385435 - protein, 22 aa, Plasmodium falciparum
KAKISIFKIFEREGQNGVPFSF

SEQ ID NO: 3385436 - protein, 22 aa, Plasmodium falciparum
KALDFLLFDMLKDNLPNNLFEI

SEQ ID NO: 3385437 - protein, 30 aa, Plasmodium falciparum
KALEQDGCLLKDKYIQVTLALNNSMQDNNK

SEQ ID NO: 3385438 - protein, 22 aa, Plasmodium falciparum
KALGIIILIHGLASHLRFGFLN

SEQ ID NO: 3385439 - protein, 18 aa, Plasmodium falciparum
KALLYSYIMRRQKYRRLR

SEQ ID NO: 3385440 - protein, 24 aa, Plasmodium falciparum
KALMDLHNFYLKDRYIKVSYTKSR

SEQ ID NO: 3385441 - protein, 27 aa, Plasmodium falciparum
KALPKSKALPILLKKNISIPKEKFTTN

SEQ ID NO: 3385442 - protein, 18 aa, Plasmodium falciparum
KAMGSACNFAWINRSSMT

SEQ ID NO: 3385443 - protein, 17 aa, Plasmodium falciparum
KAMPISLLFSNRIYENI

SEQ ID NO: 3385444 - protein, 30 aa, Plasmodium falciparum
KANFFGKAVDKWFDFIEVGKIYKISKGMIK

SEQ ID NO: 3385445 - protein, 27 aa, Plasmodium falciparum
KANKSYRDFFYRYYLNNLISDTDEQFL

SEQ ID NO: 3385446 - protein, 21 aa, Plasmodium falciparum
KANLITYNLFGIEAPIGSVEN

SEQ ID NO: 3385447 - protein, 18 aa, Plasmodium falciparum
KAPLMNPMNPEVVPPILQ

SEQ ID NO: 3385448 - protein, 24 aa, Plasmodium falciparum
KAPSKGTIKHTLEYLKRAAESRMK

SEQ ID NO: 3385449 - protein, 19 aa, Plasmodium falciparum
KAQEFWSLGFGNPFPCSGI

SEQ ID NO: 3385450 - protein, 29 aa, Plasmodium falciparum
KAQRIIQRILFRLDILDKLFILKNNSVFF

SEQ ID NO: 3385451 - protein, 30 aa, Plasmodium falciparum
KARNIYNDTCPYLLYVPRQGYFCSHHIGSQ

SEQ ID NO: 3385452 - protein, 30 aa, Plasmodium falciparum
KASDIFFNFPKFSFVIFKNRQKQVKKKLAF

SEQ ID NO: 3385453 - protein, 23 aa, Plasmodium falciparum
KASLFFYENLFIYLKELNKKKKI

SEQ ID NO: 3385454 - protein, 28 aa, Plasmodium falciparum
KASSRSHLIFIIKINRYIYSTNTIRCGK

SEQ ID NO: 3385455 - protein, 23 aa, Plasmodium falciparum
KASVIIMKNERLQKVYKGRGVND

SEQ ID NO: 3385456 - protein, 17 aa, Plasmodium falciparum
KASYIIQDLFSYYHEFV

SEQ ID NO: 3385457 - protein, 24 aa, Plasmodium falciparum
KATPNFIYKFFTEPNSQESLKWLN

SEQ ID NO: 3385458 - protein, 22 aa, Plasmodium falciparum
KATYTCLLCKRKKKINLQHLSK

SEQ ID NO: 3385459 - protein, 24 aa, Plasmodium falciparum
KAVDIFHFLCNNYISIKCPLDLIP

SEQ ID NO: 3385460 - protein, 59 aa, Plasmodium falciparum
KAYCFKHTFQYCKKSNFLNFINANKLFCFENFLYNPFNHLYNFLIGTYVFNHLNKKCSI

SEQ ID NO: 3385461 - protein, 20 aa, Plasmodium falciparum
KAYHLLLKYGAIEKKNCVKG

SEQ ID NO: 3385462 - protein, 23 aa, Plasmodium falciparum
KAYPLAKYAIMKSGGNFPYLSRH

SEQ ID NO: 3385463 - protein, 21 aa, Plasmodium falciparum
KAYTVLNQCNYVILDEADRMM

SEQ ID NO: 3385464 - protein, 18 aa, Plasmodium falciparum
KAYVPLGFVIQPLAPIPD

SEQ ID NO: 3385465 - protein, 26 aa, Plasmodium falciparum
KCAVRRCLILCPASLINNWNDEISKW

SEQ ID NO: 3385466 - protein, 31 aa, Plasmodium falciparum
KCCKLQRAYNIFIIIIFSIVKEIKNLTKELN

SEQ ID NO: 3385467 - protein, 19 aa, Plasmodium falciparum
KCCKYLHQSKYRKPYSYFK

SEQ ID NO: 3385468 - protein, 41 aa, Plasmodium falciparum
KCDHPNIIKLCGGIIHSYFDIWLVTKLVNGLDLHTIKNNMN

SEQ ID NO: 3385469 - protein, 18 aa, Plasmodium falciparum
KCDILKRTNRRYAETFLY

SEQ ID NO: 3385470 - protein, 25 aa, Plasmodium falciparum
KCDQNEYYLTKYPPNEYNPNKYHPN

SEQ ID NO: 3385471 - protein, 33 aa, Plasmodium falciparum
KCDSETLLPIANISRIMKRILPGSAKVAKESKD

SEQ ID NO: 3385472 - protein, 24 aa, Plasmodium falciparum
KCEGGVMYFPEKSLDYSRNSYKYS

SEQ ID NO: 3385473 - protein, 23 aa, Plasmodium falciparum
KCEKASILLDNPSIFEDLHIIED

SEQ ID NO: 3385474 - protein, 41 aa, Plasmodium falciparum
KCFNNKYSYRKFLKIFIQLFLDKILCIRKYIIKRKKNKNDS

SEQ ID NO: 3385475 - protein, 18 aa, Plasmodium falciparum
KCFNRPFRKSFVKDLEIK

SEQ ID NO: 3385476 - protein, 18 aa, Plasmodium falciparum
KCHHVKSYKLGKESDGWI

SEQ ID NO: 3385477 - protein, 19 aa, Plasmodium falciparum
KCIHILLSNNNFAYAAFFS

SEQ ID NO: 3385478 - protein, 18 aa, Plasmodium falciparum
KCILQTCRFLQTKGFEVT

SEQ ID NO: 3385479 - protein, 19 aa, Plasmodium falciparum
KCISLWSEELRKKSEKNNL

SEQ ID NO: 3385480 - protein, 26 aa, Plasmodium falciparum
KCITRKFHFAFLVTNIIFSKDNRLIF

SEQ ID NO: 3385481 - protein, 18 aa, Plasmodium falciparum
KCIVLGGPGFFKNDFFSY

SEQ ID NO: 3385482 - protein, 27 aa, Plasmodium falciparum
KCKEKNIPIVFALSKNLLGKCINKSRQ

SEQ ID NO: 3385483 - protein, 24 aa, Plasmodium falciparum
KCKEKNPLFYSVDFSNQKKNDIDK

SEQ ID NO: 3385484 - protein, 19 aa, Plasmodium falciparum
KCKGEKPFLLCINKNVLKK

SEQ ID NO: 3385485 - protein, 31 aa, Plasmodium falciparum
KCKIIRTYVIYNYIGLIKILKKKNKHCGNIF

SEQ ID NO: 3385486 - protein, 22 aa, Plasmodium falciparum
KCKKDLFNIREITLDNLKDINT

SEQ ID NO: 3385487 - protein, 29 aa, Plasmodium falciparum
KCKPSYEYIIPILIVLKAIGTPILQAQYN

SEQ ID NO: 3385488 - protein, 19 aa, Plasmodium falciparum
KCKRFSFGPYKYTDINTQF

SEQ ID NO: 3385489 - protein, 17 aa, Plasmodium falciparum
KCLFFTKDNLIDIEKKL

SEQ ID NO: 3385490 - protein, 24 aa, Plasmodium falciparum
KCLIEELLFERYCSAIGKNLYHKN

SEQ ID NO: 3385491 - protein, 19 aa, Plasmodium falciparum
KCNKYIYKGERFKSERRKI

SEQ ID NO: 3385492 - protein, 23 aa, Plasmodium falciparum
KCNLDDVLILWKGLGYYNRAKNL

SEQ ID NO: 3385493 - protein, 23 aa, Plasmodium falciparum
KCNQLNMIPLHKKKSIYKNEYPE

SEQ ID NO: 3385494 - protein, 31 aa, Plasmodium falciparum
KCNSKTLLPPLFLYVTFFQFKIKYLCETDNV

SEQ ID NO: 3385495 - protein, 17 aa, Plasmodium falciparum
KCPSSSYLSLNELLKFV

SEQ ID NO: 3385496 - protein, 20 aa, Plasmodium falciparum
KCSIYLMKPIKIEEQSFTNI

SEQ ID NO: 3385497 - protein, 18 aa, Plasmodium falciparum
KCSTLFHLLIRNGSIAIG

SEQ ID NO: 3385498 - protein, 24 aa, Plasmodium falciparum
KCTEGLIVITWDKFVHFFTDVEDA

SEQ ID NO: 3385499 - protein, 31 aa, Plasmodium falciparum
KCTPKKYISFLKFYWIYFNKEDLKKQNVDSF

SEQ ID NO: 3385500 - protein, 42 aa, Plasmodium falciparum
KCVHKNIMIITHLPFHLNIYNILYLLLNASLYNFDISLIKEE

SEQ ID NO: 3385501 - protein, 24 aa, Plasmodium falciparum
KCVQDIFWCYSLNNGKWTQIQNSI

SEQ ID NO: 3385502 - protein, 27 aa, Plasmodium falciparum
KCVSHPFIVKMYYAFQTKQKLYFILEY

SEQ ID NO: 3385503 - protein, 31 aa, Plasmodium falciparum
KCYANALYNSYLLQIPIRIFRHHNLENKYSP

SEQ ID NO: 3385504 - protein, 17 aa, Plasmodium falciparum
KCYDLVLDELLKVTRKK

SEQ ID NO: 3385505 - protein, 18 aa, Plasmodium falciparum
KDAYYFHKKKLNFKDRHL

SEQ ID NO: 3385506 - protein, 20 aa, Plasmodium falciparum
KDCIIFNRITKKEDFLFLIN

SEQ ID NO: 3385507 - protein, 29 aa, Plasmodium falciparum
KDCMYEKFMLYNLFSYNITCLKSSLKMMY

SEQ ID NO: 3385508 - protein, 17 aa, Plasmodium falciparum
KDCPNFSEVAKIIPQWK

SEQ ID NO: 3385509 - protein, 28 aa, Plasmodium falciparum
KDDILDNLININFKDEIKRIIQNAEATF

SEQ ID NO: 3385510 - protein, 25 aa, Plasmodium falciparum
KDDLFLTLSGLLLLGNIQFNGIEKG

SEQ ID NO: 3385511 - protein, 23 aa, Plasmodium falciparum
KDDLIPLMDPLQFLLDELIHRYI

SEQ ID NO: 3385512 - protein, 36 aa, Plasmodium falciparum
KDDSTDLYLFTYLLNIFHNSNIIVLLLSINKPNDSI

SEQ ID NO: 3385513 - protein, 23 aa, Plasmodium falciparum
KDDTFYINNKFLISENNILLEDK

SEQ ID NO: 3385514 - protein, 26 aa, Plasmodium falciparum
KDDVKKPFLVFSLPKSRNIKKRRKPI

SEQ ID NO: 3385515 - protein, 20 aa, Plasmodium falciparum
KDDVLKRYSMYLKDPKENNT

SEQ ID NO: 3385516 - protein, 25 aa, Plasmodium falciparum
KDEDNFETIFLKTRSSFSSVDSNII

SEQ ID NO: 3385517 - protein, 22 aa, Plasmodium falciparum
KDEELRKIFWEENKKFIWEGMI

SEQ ID NO: 3385518 - protein, 28 aa, Plasmodium falciparum
KDEKKNMLPRLLLKINKILDDNNLDHKK

SEQ ID NO: 3385519 - protein, 28 aa, Plasmodium falciparum
KDEKMKNFLYLFYTNKVLLQEKEELQDF

SEQ ID NO: 3385520 - protein, 26 aa, Plasmodium falciparum
KDENNILCNLLYKMKWKNIYDEKNIN

SEQ ID NO: 3385521 - protein, 22 aa, Plasmodium falciparum
KDERVKILKGELCNLIGTITAV

SEQ ID NO: 3385522 - protein, 24 aa, Plasmodium falciparum
KDFFDLYICFIDINYIFNSLSWDF

SEQ ID NO: 3385523 - protein, 21 aa, Plasmodium falciparum
KDFFSKNYILNSFSFNLMNCY

SEQ ID NO: 3385524 - protein, 21 aa, Plasmodium falciparum
KDFLLSPLKNNVLFSSSIYGV

SEQ ID NO: 3385525 - protein, 28 aa, Plasmodium falciparum
KDFSKLLLIRVLRKDRFLIALKNYITKN

SEQ ID NO: 3385526 - protein, 32 aa, Plasmodium falciparum
KDGDIYLQLFEYIWPKVMKKYKGRIIMYPSSD

SEQ ID NO: 3385527 - protein, 21 aa, Plasmodium falciparum
KDGLKLPYNFDLLLDQIDSDG

SEQ ID NO: 3385528 - protein, 23 aa, Plasmodium falciparum
KDGLLLRTYSWTVKKAIGIFLLI

SEQ ID NO: 3385529 - protein, 29 aa, Plasmodium falciparum
KDGYFLYCIDAYLPLFNSFKLAEELRSKC

SEQ ID NO: 3385530 - protein, 17 aa, Plasmodium falciparum
KDGYYPKEDYHYKNVHH

SEQ ID NO: 3385531 - protein, 27 aa, Plasmodium falciparum
KDHAAFLKYKPIIFAISIYNMSFNDTK

SEQ ID NO: 3385532 - protein, 22 aa, Plasmodium falciparum
KDHIHIFYQQFFDYYYQNFKYF

SEQ ID NO: 3385533 - protein, 27 aa, Plasmodium falciparum
KDHKKTFNIYSLLESAAQFYGEGPKYC

SEQ ID NO: 3385534 - protein, 21 aa, Plasmodium falciparum
KDHKYLAKKFQWFSPFSKSNK

SEQ ID NO: 3385535 - protein, 36 aa, Plasmodium falciparum
KDHPKNIELLYKYIMHRLYNFPFNEKPILNDYEKIF

SEQ ID NO: 3385536 - protein, 18 aa, Plasmodium falciparum
KDIFRKYPNKYESIITIL

SEQ ID NO: 3385537 - protein, 27 aa, Plasmodium falciparum
KDIGSTLLDFFLPLPTKNTNTYEKKNE

SEQ ID NO: 3385538 - protein, 19 aa, Plasmodium falciparum
KDIHNFIVNLRLGKYIFKN

SEQ ID NO: 3385539 - protein, 21 aa, Plasmodium falciparum
KDIITHVVNWFKYGGPEKNEK

SEQ ID NO: 3385540 - protein, 31 aa, Plasmodium falciparum
KDILYTYNMVFLPYHFLLTSIGEFGELVYQD

SEQ ID NO: 3385541 - protein, 19 aa, Plasmodium falciparum
KDINFEWWNSKKVSKISKD

SEQ ID NO: 3385542 - protein, 45 aa, Plasmodium falciparum
KDIPLKINFCSYKNLFYLCTRKRLYFLKLFYVKENKTLKVKNTNM

SEQ ID NO: 3385543 - protein, 29 aa, Plasmodium falciparum
KDIQGKNKLIFKYLSYDSIQKEWVVTYDY

SEQ ID NO: 3385544 - protein, 23 aa, Plasmodium falciparum
KDIRYYIYQILKALDYCHSQGIM

SEQ ID NO: 3385545 - protein, 18 aa, Plasmodium falciparum
KDISFNKNIFYPEEGNYN

SEQ ID NO: 3385546 - protein, 20 aa, Plasmodium falciparum
KDKDQLLYQKNICGGLAIAS

SEQ ID NO: 3385547 - protein, 24 aa, Plasmodium falciparum
KDKDTLINMLRKKLEIKIKDYNLI

SEQ ID NO: 3385548 - protein, 27 aa, Plasmodium falciparum
KDKFFCIFRQNFAIGIFERKKPHMNIG

SEQ ID NO: 3385549 - protein, 24 aa, Plasmodium falciparum
KDKFMKWNLRFFKVNHSKYEHFPW

SEQ ID NO: 3385550 - protein, 26 aa, Plasmodium falciparum
KDKICMQRFYYSNDYLRPVICEYKSF

SEQ ID NO: 3385551 - protein, 20 aa, Plasmodium falciparum
KDKIIFVPVGTIVRKRISCK

SEQ ID NO: 3385552 - protein, 42 aa, Plasmodium falciparum
KDKITTCHLLAYNNIIIGTDSSLFFVYNMSTNPPIYIDTKKI

SEQ ID NO: 3385553 - protein, 22 aa, Plasmodium falciparum
KDKKPLFLKYGINHITKLVENK

SEQ ID NO: 3385554 - protein, 23 aa, Plasmodium falciparum
KDKKYIILIYEYLCHAELCDEVL

SEQ ID NO: 3385555 - protein, 22 aa, Plasmodium falciparum
KDKKYKMLFKKKEGKGKPGRKK

SEQ ID NO: 3385556 - protein, 37 aa, Plasmodium falciparum
KDKLEKVAFVLRKLLARKLQLGYTPPLKFVPLSDQQE

SEQ ID NO: 3385557 - protein, 21 aa, Plasmodium falciparum
KDKLKRYSSFDQKVDIKRGDE

SEQ ID NO: 3385558 - protein, 25 aa, Plasmodium falciparum
KDKNEYEFTLNFLKPINVEESKYST

SEQ ID NO: 3385559 - protein, 26 aa, Plasmodium falciparum
KDKNLFFYYTHIIYLSLIKSQNNKIT

SEQ ID NO: 3385560 - protein, 26 aa, Plasmodium falciparum
KDKNLYNNLHITNCLLFKKETTEEVL

SEQ ID NO: 3385561 - protein, 25 aa, Plasmodium falciparum
KDKNYNALKTLKDSKRILLNCNKYI

SEQ ID NO: 3385562 - protein, 26 aa, Plasmodium falciparum
KDKQGIKAPLILKKVDKRSGVIVQAP

SEQ ID NO: 3385563 - protein, 33 aa, Plasmodium falciparum
KDKQKTFKLDMNILCYFVTAGINPPVSFDEIDS

SEQ ID NO: 3385564 - protein, 25 aa, Plasmodium falciparum
KDKSIFLWKGIYPFNKMREWNGHID

SEQ ID NO: 3385565 - protein, 20 aa, Plasmodium falciparum
KDKYFNCLRCKYICLSVVKM

SEQ ID NO: 3385566 - protein, 27 aa, Plasmodium falciparum
KDKYNKFNNIFYFLDNYKKCDNNIILI

SEQ ID NO: 3385567 - protein, 20 aa, Plasmodium falciparum
KDLEKYFSKFGKIVDIYVSR

SEQ ID NO: 3385568 - protein, 20 aa, Plasmodium falciparum
KDLFCTLYALIDIYDCYSEL

SEQ ID NO: 3385569 - protein, 23 aa, Plasmodium falciparum
KDLGHWAGLFKLDNEGNARKIIG

SEQ ID NO: 3385570 - protein, 27 aa, Plasmodium falciparum
KDLKFYSKDFVIYKNLELIYNESDVHI

SEQ ID NO: 3385571 - protein, 33 aa, Plasmodium falciparum
KDLKILRVLTKEELILKMIDGVLLRKIGVNSQN

SEQ ID NO: 3385572 - protein, 26 aa, Plasmodium falciparum
KDLKKLNLLINPFHEKLIKDTHNANF

SEQ ID NO: 3385573 - protein, 17 aa, Plasmodium falciparum
KDLLKYFNGWLLCPPSN

SEQ ID NO: 3385574 - protein, 33 aa, Plasmodium falciparum
KDLLNNNMTYIYNYPMMNTLNYSKDNNYCTYLD

SEQ ID NO: 3385575 - protein, 26 aa, Plasmodium falciparum
KDLNKNNIYYNKYSNFLVLQEYVISY

SEQ ID NO: 3385576 - protein, 21 aa, Plasmodium falciparum
KDLNLITLSEYLNNLRNVKLE

SEQ ID NO: 3385577 - protein, 23 aa, Plasmodium falciparum
KDLQNFHFSFDQAIIKFHSLKMQ

SEQ ID NO: 3385578 - protein, 29 aa, Plasmodium falciparum
KDLSRIGMPIYLNEPSSFLQRLAEDFQYI

SEQ ID NO: 3385579 - protein, 18 aa, Plasmodium falciparum
KDLVKVHEILIYKEKLET

SEQ ID NO: 3385580 - protein, 26 aa, Plasmodium falciparum
KDMIKQENIILPFAEKNIMTNDKIEK

SEQ ID NO: 3385581 - protein, 23 aa, Plasmodium falciparum
KDMKYEIKYLYFSEDDKIFISSA

SEQ ID NO: 3385582 - protein, 29 aa, Plasmodium falciparum
KDMQKYYFKLYIIIKIKYPYGIYIFNCDD

SEQ ID NO: 3385583 - protein, 66 aa, Plasmodium falciparum
KDMRINLCRDAILFILHDLETILELNIPMLSKNVNMYKLCIKHHLNYLTLIKNEEQIIPYLNVFGD

SEQ ID NO: 3385584 - protein, 23 aa, Plasmodium falciparum
KDMYKSNYYFFKSDDDYYYDEEV

SEQ ID NO: 3385585 - protein, 23 aa, Plasmodium falciparum
KDNCIRYVIFPPGHYYKNNKNKG

SEQ ID NO: 3385586 - protein, 24 aa, Plasmodium falciparum
KDNDWSYLRSGANTSFRNSIKNNE

SEQ ID NO: 3385587 - protein, 29 aa, Plasmodium falciparum
KDNEKRIFLMENYWEYSILTLHDFNVNMV

SEQ ID NO: 3385588 - protein, 29 aa, Plasmodium falciparum
KDNFHLRVRIHPFHVLRINKMLSCAGADR

SEQ ID NO: 3385589 - protein, 25 aa, Plasmodium falciparum
KDNIKNNLMFLKNQSEFLRNKNEEF

SEQ ID NO: 3385590 - protein, 26 aa, Plasmodium falciparum
KDNKINKFFKNLGRFSFTTSKKKNNK

SEQ ID NO: 3385591 - protein, 26 aa, Plasmodium falciparum
KDNKRHIIRLLSSIKYKNHLCLVFEW

SEQ ID NO: 3385592 - protein, 25 aa, Plasmodium falciparum
KDNKTNALLLKLKKKKKKKMVQMRK

SEQ ID NO: 3385593 - protein, 25 aa, Plasmodium falciparum
KDNLILFNELLKYKDEFNYLNEQKV

SEQ ID NO: 3385594 - protein, 18 aa, Plasmodium falciparum
KDNLLARFDFLFELGFEK

SEQ ID NO: 3385595 - protein, 17 aa, Plasmodium falciparum
KDNLYIFSLRSIPSNKH

SEQ ID NO: 3385596 - protein, 28 aa, Plasmodium falciparum
KDNNIHHMEHCYICSYPIQNNEQKFILH

SEQ ID NO: 3385597 - protein, 24 aa, Plasmodium falciparum
KDNVEKIHLNKMLPYLVANVVESL

SEQ ID NO: 3385598 - protein, 22 aa, Plasmodium falciparum
KDNYTIIFLFSVNESGGFQGYA

SEQ ID NO: 3385599 - protein, 30 aa, Plasmodium falciparum
KDPLAPKRALSAYMFYVKDKRLEIIKEKPE

SEQ ID NO: 3385600 - protein, 23 aa, Plasmodium falciparum
KDQVPLVYFYDKNNIRIGKFYIE

SEQ ID NO: 3385601 - protein, 23 aa, Plasmodium falciparum
KDQYINLLQFMSVPMYFTSHLKA

SEQ ID NO: 3385602 - protein, 26 aa, Plasmodium falciparum
KDRPNKHMILILNKIDLIPVSVAEKW

SEQ ID NO: 3385603 - protein, 21 aa, Plasmodium falciparum
KDRSYNLWKRITVDDIKNTHF

SEQ ID NO: 3385604 - protein, 24 aa, Plasmodium falciparum
KDRVKFLRRYSFLSLFLGAAFTYK

SEQ ID NO: 3385605 - protein, 26 aa, Plasmodium falciparum
KDSDSNMFMKKGNMYNMRYNRYTENS

SEQ ID NO: 3385606 - protein, 25 aa, Plasmodium falciparum
KDSFKENFLFFKEKILPSKKDTCVF

SEQ ID NO: 3385607 - protein, 41 aa, Plasmodium falciparum
KDSIDYCLSTYLYWLYLRRNTNIFLQNTLLIPTCMRKNDND

SEQ ID NO: 3385608 - protein, 25 aa, Plasmodium falciparum
KDSKKIKEILKKKLSLFINEKDINV

SEQ ID NO: 3385609 - protein, 23 aa, Plasmodium falciparum
KDSNYFLIPSLLLSLANLNIYDQ

SEQ ID NO: 3385610 - protein, 23 aa, Plasmodium falciparum
KDSNYLHFICSNLVNNIRGICSQ

SEQ ID NO: 3385611 - protein, 38 aa, Plasmodium falciparum
KDSSNKPYTFFVAGKFNLFSNFVLIKKLKDVGYNITYN

SEQ ID NO: 3385612 - protein, 28 aa, Plasmodium falciparum
KDSSYLVHAIIYVIELPLSVSQKYLHKK

SEQ ID NO: 3385613 - protein, 20 aa, Plasmodium falciparum
KDSVLLIPPLNFSYTHHTIK

SEQ ID NO: 3385614 - protein, 19 aa, Plasmodium falciparum
KDTFNLLNKLKTNQKNREY

SEQ ID NO: 3385615 - protein, 27 aa, Plasmodium falciparum
KDTIQKLFKVPFYPDAYFLVRDHKVVV

SEQ ID NO: 3385616 - protein, 27 aa, Plasmodium falciparum
KDTKRTSFIQYPYYLDKKKERAYTLGA

SEQ ID NO: 3385617 - protein, 22 aa, Plasmodium falciparum
KDTNIFEWVGFIKGPSGTPYEG

SEQ ID NO: 3385618 - protein, 26 aa, Plasmodium falciparum
KDTYHFNDFLKWYKINIGKLYTSEQV

SEQ ID NO: 3385619 - protein, 25 aa, Plasmodium falciparum
KDTYNKYYYALFNNNIFNQKKLYIF

SEQ ID NO: 3385620 - protein, 29 aa, Plasmodium falciparum
KDTYPHLFRWFHHISSLPEFILNQYDEEH

SEQ ID NO: 3385621 - protein, 26 aa, Plasmodium falciparum
KDVLNKLFLMLLFEITKRIDKMNTQS

SEQ ID NO: 3385622 - protein, 21 aa, Plasmodium falciparum
KDYDLYISQLKDKNINPLIRT

SEQ ID NO: 3385623 - protein, 24 aa, Plasmodium falciparum
KDYEGKYFSARYDGNTYFTRSKTK

SEQ ID NO: 3385624 - protein, 17 aa, Plasmodium falciparum
KDYFFIKFYKNQVELKE

SEQ ID NO: 3385625 - protein, 31 aa, Plasmodium falciparum
KDYICTNKYMWRFLQFLYNGGPCIKRISNNI

SEQ ID NO: 3385626 - protein, 24 aa, Plasmodium falciparum
KDYKKYFNFLITKKNKRETHKSTN

SEQ ID NO: 3385627 - protein, 18 aa, Plasmodium falciparum
KDYLYFYDIRNEKWHNIL

SEQ ID NO: 3385628 - protein, 21 aa, Plasmodium falciparum
KDYNSIYKKVLWPINHGIYDF

SEQ ID NO: 3385629 - protein, 24 aa, Plasmodium falciparum
KDYNSYMTMPYSNKKDIKYYKKKG

SEQ ID NO: 3385630 - protein, 33 aa, Plasmodium falciparum
KDYSFKSNRPYVLYMNNPLYIWDISNDKKNRIV

SEQ ID NO: 3385631 - protein, 28 aa, Plasmodium falciparum
KDYVEKHNLLYRLFLKISNNINKKKEKT

SEQ ID NO: 3385632 - protein, 17 aa, Plasmodium falciparum
KDYVSTNLYRTKIVKDD

SEQ ID NO: 3385633 - protein, 20 aa, Plasmodium falciparum
KDYVYIYLEKVINDIINISH

SEQ ID NO: 3385634 - protein, 19 aa, Plasmodium falciparum
KDYYGVLTLVDLVGCEREE

SEQ ID NO: 3385635 - protein, 26 aa, Plasmodium falciparum
KEAFLENVDRRLFPNEDFMVKEEFMD

SEQ ID NO: 3385636 - protein, 18 aa, Plasmodium falciparum
KEAKAKHPLIKFTYNMQA

SEQ ID NO: 3385637 - protein, 25 aa, Plasmodium falciparum
KEAKNIFRNFLMKFNYIKYDSDEYN

SEQ ID NO: 3385638 - protein, 23 aa, Plasmodium falciparum
KEANLFHVVFYDYEQFNTNKNIK

SEQ ID NO: 3385639 - protein, 21 aa, Plasmodium falciparum
KEAPLILTAYTQFCAVRIPDN

SEQ ID NO: 3385640 - protein, 34 aa, Plasmodium falciparum
KEASRKWKIIARNILHKEMQLLLETIHYDKYENK

SEQ ID NO: 3385641 - protein, 18 aa, Plasmodium falciparum
KEATDLIKLIYSYDATEN

SEQ ID NO: 3385642 - protein, 18 aa, Plasmodium falciparum
KEAYNYHNKLKILNKNYL

SEQ ID NO: 3385643 - protein, 20 aa, Plasmodium falciparum
KECFNLFHPLTYMHSILNEK

SEQ ID NO: 3385644 - protein, 20 aa, Plasmodium falciparum
KECIKKYSLPIIMGGSHVAT

SEQ ID NO: 3385645 - protein, 20 aa, Plasmodium falciparum
KECMMLAEKLYNKGYISYPR

SEQ ID NO: 3385646 - protein, 33 aa, Plasmodium falciparum
KECNEIFVDNFIKKYLFLKNNPHKNIISIYDIF

SEQ ID NO: 3385647 - protein, 19 aa, Plasmodium falciparum
KEDIVVKDTFNLLNKLKTN

SEQ ID NO: 3385648 - protein, 23 aa, Plasmodium falciparum
KEDKEYIIKWNKKTGVSIYYNKN

SEQ ID NO: 3385649 - protein, 17 aa, Plasmodium falciparum
KEDLLPKLPSKKSLKPY

SEQ ID NO: 3385650 - protein, 25 aa, Plasmodium falciparum
KEDLNRINLLFGFNILSISEQKNVI

SEQ ID NO: 3385651 - protein, 25 aa, Plasmodium falciparum
KEDLYSCIPILLSRKNLGDNMKKMN

SEQ ID NO: 3385652 - protein, 24 aa, Plasmodium falciparum
KEDMIIKIIDFGLSTHFEYSKKMK

SEQ ID NO: 3385653 - protein, 25 aa, Plasmodium falciparum
KEDNKFFRSEFIKDYNMNYNDCGLI

SEQ ID NO: 3385654 - protein, 23 aa, Plasmodium falciparum
KEDSILSLPPIFINSNSCEYIQV

SEQ ID NO: 3385655 - protein, 26 aa, Plasmodium falciparum
KEDTSYKLKSLYLLNEYLNVEPTNNV

SEQ ID NO: 3385656 - protein, 21 aa, Plasmodium falciparum
KEDTYYRLVDPWSTTTKMKNM

SEQ ID NO: 3385657 - protein, 38 aa, Plasmodium falciparum
KEECIAIINFLRWKKVRKNFYEILKLKKKRKENLMIYK

SEQ ID NO: 3385658 - protein, 41 aa, Plasmodium falciparum
KEEEAGQFVIPLYMRSPKPEQIPIPLYFSEGENIILPKEED

SEQ ID NO: 3385659 - protein, 24 aa, Plasmodium falciparum
KEEEKLKILQIIDNYLQKNEMFFN

SEQ ID NO: 3385660 - protein, 19 aa, Plasmodium falciparum
KEEHFYYPFNEHDAIKVLQ

SEQ ID NO: 3385661 - protein, 17 aa, Plasmodium falciparum
KEEIKLKINNCLKMIFV

SEQ ID NO: 3385662 - protein, 25 aa, Plasmodium falciparum
KEEINELFLKECINSFRLQNNKSRK

SEQ ID NO: 3385663 - protein, 18 aa, Plasmodium falciparum
KEEINKYIKLLYISIDIG

SEQ ID NO: 3385664 - protein, 67 aa, Plasmodium falciparum
KEEITMLDSWYFANKMKIIPYLFDDKPIHINLLNSLYMLHPYFKNHKTKIIIYLRFVKNKYQNIIKK

SEQ ID NO: 3385665 - protein, 34 aa, Plasmodium falciparum
KEEKKIRTKLLNAAKWKGKKIAPSGCLPISTEDI

SEQ ID NO: 3385666 - protein, 25 aa, Plasmodium falciparum
KEEKKMPPLSHMFDSIVKIKKQVDS

SEQ ID NO: 3385667 - protein, 18 aa, Plasmodium falciparum
KEEKLLINQIQALNKNKP

SEQ ID NO: 3385668 - protein, 26 aa, Plasmodium falciparum
KEEKVFVTSAYKKKLMDRELIKKDMD

SEQ ID NO: 3385669 - protein, 24 aa, Plasmodium falciparum
KEENFNFNLIINKEKKRPPKLSNN

SEQ ID NO: 3385670 - protein, 23 aa, Plasmodium falciparum
KEENIFRPLFNLNKKDKVWKRFN

SEQ ID NO: 3385671 - protein, 25 aa, Plasmodium falciparum
KEENIILLNYYYYHIKHIHTYTNDS

SEQ ID NO: 3385672 - protein, 26 aa, Plasmodium falciparum
KEENYFNHFLFIDLCLYFNQNEEDIS

SEQ ID NO: 3385673 - protein, 26 aa, Plasmodium falciparum
KEENYLDRLTNLFKYLTLGVEKNNST

SEQ ID NO: 3385674 - protein, 18 aa, Plasmodium falciparum
KEENYLLHFLKEDKTKFF

SEQ ID NO: 3385675 - protein, 27 aa, Plasmodium falciparum
KEESPIWLHIDIMVKVITPGPFYNEIG

SEQ ID NO: 3385676 - protein, 19 aa, Plasmodium falciparum
KEETTAFFMKKFFPTNEND

SEQ ID NO: 3385677 - protein, 26 aa, Plasmodium falciparum
KEEYEYYIKNLFFDILKIENIHHVYD

SEQ ID NO: 3385678 - protein, 20 aa, Plasmodium falciparum
KEFFVLPTFVNSVSMSGILF

SEQ ID NO: 3385679 - protein, 26 aa, Plasmodium falciparum
KEFKIIYIAPMKSLVFEITNLFRKKL

SEQ ID NO: 3385680 - protein, 33 aa, Plasmodium falciparum
KEFKVIDFFTIYRLDMTTFQWEKINITYNRLLN

SEQ ID NO: 3385681 - protein, 21 aa, Plasmodium falciparum
KEFLRRYLLCFFCCTDLNNCV

SEQ ID NO: 3385682 - protein, 27 aa, Plasmodium falciparum
KEFLYHVNWGILDYLIIDMPPGTNDIH

SEQ ID NO: 3385683 - protein, 17 aa, Plasmodium falciparum
KEFMRLMKTKYCRARIL

SEQ ID NO: 3385684 - protein, 18 aa, Plasmodium falciparum
KEFNNDKIRGAFFFKVKL

SEQ ID NO: 3385685 - protein, 18 aa, Plasmodium falciparum
KEGANTITFLVTSSLQGT

SEQ ID NO: 3385686 - protein, 22 aa, Plasmodium falciparum
KEGEAFMMRYAPKAKDLASRDV

SEQ ID NO: 3385687 - protein, 21 aa, Plasmodium falciparum
KEGFFFFFSSFKRSCNNNIHF

SEQ ID NO: 3385688 - protein, 17 aa, Plasmodium falciparum
KEGFVTCYIYYGTSKDI

SEQ ID NO: 3385689 - protein, 17 aa, Plasmodium falciparum
KEGGILYLYKGVIPRCF

SEQ ID NO: 3385690 - protein, 26 aa, Plasmodium falciparum
KEGSKTYIYIFLFRGEEIGKKKITDI

SEQ ID NO: 3385691 - protein, 22 aa, Plasmodium falciparum
KEHAPSYNFPMTKQKHWNVTLN

SEQ ID NO: 3385692 - protein, 17 aa, Plasmodium falciparum
KEHEPLWVINASNEEKK

SEQ ID NO: 3385693 - protein, 19 aa, Plasmodium falciparum
KEHIPDRGIEIKKYDRSSK

SEQ ID NO: 3385694 - protein, 23 aa, Plasmodium falciparum
KEHIYKCPYCEICTCSLVCSKNH

SEQ ID NO: 3385695 - protein, 18 aa, Plasmodium falciparum
KEHRILVEKLKKKIDNLK

SEQ ID NO: 3385696 - protein, 33 aa, Plasmodium falciparum
KEIADYFYINNFCLHFNGIKLYVDKKGIFSFDH

SEQ ID NO: 3385697 - protein, 18 aa, Plasmodium falciparum
KEIAPKKKSFFNISKRKG

SEQ ID NO: 3385698 - protein, 34 aa, Plasmodium falciparum
KEIDILFIIDQLYDYFYFVLYVPITTKEKDLIFF

SEQ ID NO: 3385699 - protein, 21 aa, Plasmodium falciparum
KEIEFLKNIAKEHSLKKIEKN

SEQ ID NO: 3385700 - protein, 23 aa, Plasmodium falciparum
KEIEKLTMLLVRLKHEKLYTKCN

SEQ ID NO: 3385701 - protein, 25 aa, Plasmodium falciparum
KEIEKNFMIITLFIEKKLKDLSDDV

SEQ ID NO: 3385702 - protein, 22 aa, Plasmodium falciparum
KEIFKKGVNYILLPSLPRSNNL

SEQ ID NO: 3385703 - protein, 18 aa, Plasmodium falciparum
KEIFNFLILIEEFNPFDY

SEQ ID NO: 3385704 - protein, 22 aa, Plasmodium falciparum
KEIHIPVLIFVDSIIKANMIYT

SEQ ID NO: 3385705 - protein, 21 aa, Plasmodium falciparum
KEIILFSCVMCPTQLEKKREK

SEQ ID NO: 3385706 - protein, 21 aa, Plasmodium falciparum
KEIIRALILSDINVSYLKDIK

SEQ ID NO: 3385707 - protein, 37 aa, Plasmodium falciparum
KEIKKLWNKELTFKFFNFYPFIMSSLNLMAKHKLLKD

SEQ ID NO: 3385708 - protein, 24 aa, Plasmodium falciparum
KEIKPKFPLKKKANLNFIGAAAAP

SEQ ID NO: 3385709 - protein, 25 aa, Plasmodium falciparum
KEIKYIIFELLLALSYFHSNNYIHR

SEQ ID NO: 3385710 - protein, 19 aa, Plasmodium falciparum
KEILLEYNSLNLSLSSDNI

SEQ ID NO: 3385711 - protein, 18 aa, Plasmodium falciparum
KEILLSKENIINYSLNSS

SEQ ID NO: 3385712 - protein, 26 aa, Plasmodium falciparum
KEILNCLRMISRIKKIFFDECSKMIN

SEQ ID NO: 3385713 - protein, 17 aa, Plasmodium falciparum
KEILYDKSSKHQSDELH

SEQ ID NO: 3385714 - protein, 31 aa, Plasmodium falciparum
KEIMIISQIPYYNFISWKFLTVMESFLIDKE

SEQ ID NO: 3385715 - protein, 27 aa, Plasmodium falciparum
KEINIFLKNLSFFLLSYKVIKYQVYEY

SEQ ID NO: 3385716 - protein, 24 aa, Plasmodium falciparum
KEINKILNKIYLKKKKFIQDIIGD

SEQ ID NO: 3385717 - protein, 33 aa, Plasmodium falciparum
KEIRRKVESILKIRMPHFNYGSNKNNVFLNKNV

SEQ ID NO: 3385718 - protein, 18 aa, Plasmodium falciparum
KEISYKKMLLKMNQINDT

SEQ ID NO: 3385719 - protein, 26 aa, Plasmodium falciparum
KEITLKIIRRCRIYSLKQLHTEKKNI

SEQ ID NO: 3385720 - protein, 18 aa, Plasmodium falciparum
KEITLLDILTKGGKKRKA

SEQ ID NO: 3385721 - protein, 25 aa, Plasmodium falciparum
KEIVEDIFQLNMRNPYIVNSYGNNS

SEQ ID NO: 3385722 - protein, 17 aa, Plasmodium falciparum
KEKDDIVLKIPSSILII

SEQ ID NO: 3385723 - protein, 19 aa, Plasmodium falciparum
KEKDFGLDIIKQADHLQLQ

SEQ ID NO: 3385724 - protein, 23 aa, Plasmodium falciparum
KEKDIIIYKLNKKIEEIRVYLKG

SEQ ID NO: 3385725 - protein, 25 aa, Plasmodium falciparum
KEKEDYLLSLYFKGELKKDQIIIQP

SEQ ID NO: 3385726 - protein, 24 aa, Plasmodium falciparum
KEKEFIRIAYYMNSFYKDMELREN

SEQ ID NO: 3385727 - protein, 21 aa, Plasmodium falciparum
KEKELFIKGKETLLLEGMNDG

SEQ ID NO: 3385728 - protein, 25 aa, Plasmodium falciparum
KEKERLFCEIGLPRMIPRAKVRESE

SEQ ID NO: 3385729 - protein, 20 aa, Plasmodium falciparum
KEKFGIIEFYNHENAKDAIN

SEQ ID NO: 3385730 - protein, 26 aa, Plasmodium falciparum
KEKFKKYIHSVLPIVGDYMYRVVTKN

SEQ ID NO: 3385731 - protein, 23 aa, Plasmodium falciparum
KEKFKLYYKQLIYARLKKLFMKK

SEQ ID NO: 3385732 - protein, 35 aa, Plasmodium falciparum
KEKKASVYFSNNQKFLYFAVPLMSQDKSCDYNIND

SEQ ID NO: 3385733 - protein, 26 aa, Plasmodium falciparum
KEKKEGFILSFYFATNPFFSNSVLTK

SEQ ID NO: 3385734 - protein, 25 aa, Plasmodium falciparum
KEKKKCFIVLGCGCYRIGSSVEFDW

SEQ ID NO: 3385735 - protein, 17 aa, Plasmodium falciparum
KEKKKFVLYKKKKNKSN

SEQ ID NO: 3385736 - protein, 24 aa, Plasmodium falciparum
KEKKKWIIQILEQKNNTILYFKEF

SEQ ID NO: 3385737 - protein, 27 aa, Plasmodium falciparum
KEKKNINDFFLLSKFKYSKQVIDKKEN

SEQ ID NO: 3385738 - protein, 18 aa, Plasmodium falciparum
KEKKNNDVDDINEEEDEE

SEQ ID NO: 3385739 - protein, 37 aa, Plasmodium falciparum
KEKKQIDIMYKNLSRLNLNLLLPTKKKVKKSKNSFKK

SEQ ID NO: 3385740 - protein, 21 aa, Plasmodium falciparum
KEKKQMHYHIKKIIKYKQEKD

SEQ ID NO: 3385741 - protein, 17 aa, Plasmodium falciparum
KEKLNHAVFIDKSLHSK

SEQ ID NO: 3385742 - protein, 34 aa, Plasmodium falciparum
KEKLRNWIAIFYEKMADILFVYESELFHGLAWLK

SEQ ID NO: 3385743 - protein, 22 aa, Plasmodium falciparum
KEKNLLLHKYGKEVSPCVVRFV

SEQ ID NO: 3385744 - protein, 23 aa, Plasmodium falciparum
KEKNPFFHIQPHLILKDGVAHYK

SEQ ID NO: 3385745 - protein, 22 aa, Plasmodium falciparum
KEKNYLYKYWSYSLQDILNGTE

SEQ ID NO: 3385746 - protein, 22 aa, Plasmodium falciparum
KEKQILINFIGYTLTNTQTKKN

SEQ ID NO: 3385747 - protein, 18 aa, Plasmodium falciparum
KEKRKICRIFFLTHFHAD

SEQ ID NO: 3385748 - protein, 33 aa, Plasmodium falciparum
KEKTYPSFIYTNIYKIPVLSSVHFHIFKNYIKQ

SEQ ID NO: 3385749 - protein, 33 aa, Plasmodium falciparum
KEKVKSYLFVLTRKYVLLLLEYDVKENDFITLS

SEQ ID NO: 3385750 - protein, 24 aa, Plasmodium falciparum
KEKWNEFIQYIQNLKDYTKCGVDR

SEQ ID NO: 3385751 - protein, 22 aa, Plasmodium falciparum
KEKYKYITLFNSIVVNKIEGSL

SEQ ID NO: 3385752 - protein, 25 aa, Plasmodium falciparum
KELATPLCMWKLPNKELINRNIANK

SEQ ID NO: 3385753 - protein, 25 aa, Plasmodium falciparum
KELDEILKDVIFLELGLKESKSKNE

SEQ ID NO: 3385754 - protein, 22 aa, Plasmodium falciparum
KELDQEMILDIIDNLSSFVKNK

SEQ ID NO: 3385755 - protein, 17 aa, Plasmodium falciparum
KELILAEKLKCGWGFPT

SEQ ID NO: 3385756 - protein, 35 aa, Plasmodium falciparum
KELINAYFEYTTSNLYYIFIKYENIICDMSEMNVH

SEQ ID NO: 3385757 - protein, 23 aa, Plasmodium falciparum
KELKIYILYSLSILLKNYELKKY

SEQ ID NO: 3385758 - protein, 17 aa, Plasmodium falciparum
KELKNSYLIFINTQKDT

SEQ ID NO: 3385759 - protein, 36 aa, Plasmodium falciparum
KELKSIVDFFFCINYFLKFAAHINSVYYLVIEVLKK

SEQ ID NO: 3385760 - protein, 21 aa, Plasmodium falciparum
KELKVAMRALGFEPKKEDIRK

SEQ ID NO: 3385761 - protein, 18 aa, Plasmodium falciparum
KELLFLTELIKTIKDKKN

SEQ ID NO: 3385762 - protein, 22 aa, Plasmodium falciparum
KELMQFRRYINYILSKNHSAKI

SEQ ID NO: 3385763 - protein, 20 aa, Plasmodium falciparum
KELPLYSKFFLTINDEYLEM

SEQ ID NO: 3385764 - protein, 20 aa, Plasmodium falciparum
KELRELYYKLENEQKEKVID

SEQ ID NO: 3385765 - protein, 24 aa, Plasmodium falciparum
KELRKELILKKKNYEELRLKLNHL

SEQ ID NO: 3385766 - protein, 17 aa, Plasmodium falciparum
KELTHYLSSFYYKIMNH

SEQ ID NO: 3385767 - protein, 21 aa, Plasmodium falciparum
KELYTSFNFDLKNLNYEDIED

SEQ ID NO: 3385768 - protein, 28 aa, Plasmodium falciparum
KEMGCKYVLLFLSFIPDIINLGFNIKNY

SEQ ID NO: 3385769 - protein, 17 aa, Plasmodium falciparum
KEMPIFCLLINEEKKII

SEQ ID NO: 3385770 - protein, 36 aa, Plasmodium falciparum
KEMTKQINYYLPPTLSIKIWKLAFCSSIHGVSFKTL

SEQ ID NO: 3385771 - protein, 22 aa, Plasmodium falciparum
KEMTTALLNIIKMKSSKTNVNN

SEQ ID NO: 3385772 - protein, 21 aa, Plasmodium falciparum
KENEINLLSKLQDCRNKSGKG

SEQ ID NO: 3385773 - protein, 23 aa, Plasmodium falciparum
KENEKECYLLSQKKKQSTYVFDS

SEQ ID NO: 3385774 - protein, 24 aa, Plasmodium falciparum
KENELLEIFQPFGLIESIKLKVNK

SEQ ID NO: 3385775 - protein, 28 aa, Plasmodium falciparum
KENHDFSKFLYIIKDIKNIFQTKFQTSA

SEQ ID NO: 3385776 - protein, 27 aa, Plasmodium falciparum
KENHGIHTIYFLLSSNDLIEIDKKDTL

SEQ ID NO: 3385777 - protein, 25 aa, Plasmodium falciparum
KENHLNAEKIFKYLNDLFNQEEIIN

SEQ ID NO: 3385778 - protein, 28 aa, Plasmodium falciparum
KENIHLKNHLDFIYNTEFFTELYVEDEY

SEQ ID NO: 3385779 - protein, 17 aa, Plasmodium falciparum
KENIIEKFLLNINSLSE

SEQ ID NO: 3385780 - protein, 20 aa, Plasmodium falciparum
KENIKKNHFLKSFLSGEHNY

SEQ ID NO: 3385781 - protein, 22 aa, Plasmodium falciparum
KENINFIKKDSQYLLYKNDNLP

SEQ ID NO: 3385782 - protein, 18 aa, Plasmodium falciparum
KENIQKICATPYTGSNIS

SEQ ID NO: 3385783 - protein, 25 aa, Plasmodium falciparum
KENKEIILLNIYLELSNDHLEMLLK

SEQ ID NO: 3385784 - protein, 34 aa, Plasmodium falciparum
KENKTFIYNHILFWTIKITFVNLNIRILHHEINE

SEQ ID NO: 3385785 - protein, 18 aa, Plasmodium falciparum
KENLLLEKNLGKVQILTQ

SEQ ID NO: 3385786 - protein, 18 aa, Plasmodium falciparum
KENLNSMILLNDNNSNNG

SEQ ID NO: 3385787 - protein, 24 aa, Plasmodium falciparum
KENMKHMDILNIRGKRKKNGNINM

SEQ ID NO: 3385788 - protein, 19 aa, Plasmodium falciparum
KENMVYNFLANYDKKEKKY

SEQ ID NO: 3385789 - protein, 26 aa, Plasmodium falciparum
KENNEGIVVFTYPKANTPGCTKQAEL

SEQ ID NO: 3385790 - protein, 18 aa, Plasmodium falciparum
KENNFFSEIFKKVKNKIY

SEQ ID NO: 3385791 - protein, 32 aa, Plasmodium falciparum
KENNMFHDVDNFTSLLLHINNYNEKDFMNFKN

SEQ ID NO: 3385792 - protein, 23 aa, Plasmodium falciparum
KENPKDHLYLNFLNNLENKLNRI

SEQ ID NO: 3385793 - protein, 18 aa, Plasmodium falciparum
KENSRMKQVLLKLIQKES

SEQ ID NO: 3385794 - protein, 24 aa, Plasmodium falciparum
KENTNLLGWKIKYYKGLGTSTDRE

SEQ ID NO: 3385795 - protein, 33 aa, Plasmodium falciparum
KENVYLLYEYADYDLWEFLKIRSVGVNEKITFN

SEQ ID NO: 3385796 - protein, 34 aa, Plasmodium falciparum
KENYEYEIKLYYLFKLYHYFKKKEKFKEDLLLYK

SEQ ID NO: 3385797 - protein, 24 aa, Plasmodium falciparum
KEPRGFGFVEFYDAKDAEQALKEM

SEQ ID NO: 3385798 - protein, 21 aa, Plasmodium falciparum
KEPYRNIPPSGYDKNKLLYPE

SEQ ID NO: 3385799 - protein, 25 aa, Plasmodium falciparum
KEQGPFNSYTIFNWVSNEYFEDNTL

SEQ ID NO: 3385800 - protein, 22 aa, Plasmodium falciparum
KEQKRKINPMYSDLFGRKTPDV

SEQ ID NO: 3385801 - protein, 23 aa, Plasmodium falciparum
KEQKYNLWRWGCPGDSLFSSIKV

SEQ ID NO: 3385802 - protein, 25 aa, Plasmodium falciparum
KEQLKAYICKLRKELRNYKMRELHL

SEQ ID NO: 3385803 - protein, 25 aa, Plasmodium falciparum
KEQMKYPFFIAPTYDYYISSNGYAT

SEQ ID NO: 3385804 - protein, 29 aa, Plasmodium falciparum
KEQRIVQDKIFFLEYITLNVTHMENANIY

SEQ ID NO: 3385805 - protein, 26 aa, Plasmodium falciparum
KERDKNKFLLLQNRRLKCIIIESNCN

SEQ ID NO: 3385806 - protein, 22 aa, Plasmodium falciparum
KERDMLNYSEYYKDILLKEGSQ

SEQ ID NO: 3385807 - protein, 22 aa, Plasmodium falciparum
KERGVFVIFLPCIEQVYKILEA

SEQ ID NO: 3385808 - protein, 28 aa, Plasmodium falciparum
KERICRDFKMLSNMKCKGEKPFLLCINK

SEQ ID NO: 3385809 - protein, 25 aa, Plasmodium falciparum
KERIDKKYHRVPLGYHTTKESWNNY

SEQ ID NO: 3385810 - protein, 28 aa, Plasmodium falciparum
KERIEFSYIYRWYLHIQETLLANFSTLK

SEQ ID NO: 3385811 - protein, 17 aa, Plasmodium falciparum
KERIIKNDKDLLKELQK

SEQ ID NO: 3385812 - protein, 17 aa, Plasmodium falciparum
KERNFIFHIIGNNEPFN

SEQ ID NO: 3385813 - protein, 24 aa, Plasmodium falciparum
KERRGLILLPENYIRYNLNEDNYK

SEQ ID NO: 3385814 - protein, 17 aa, Plasmodium falciparum
KERVDNFNWLKEKIQLL

SEQ ID NO: 3385815 - protein, 20 aa, Plasmodium falciparum
KESCLIFQILLKIKEDDIKE

SEQ ID NO: 3385816 - protein, 29 aa, Plasmodium falciparum
KESDFKLMKIYAIIPVKFTHNYSSILRSI

SEQ ID NO: 3385817 - protein, 19 aa, Plasmodium falciparum
KESFLYNEFYFTPCGYSCN

SEQ ID NO: 3385818 - protein, 23 aa, Plasmodium falciparum
KESIDNILLFHSLAGGSGSGLSS

SEQ ID NO: 3385819 - protein, 23 aa, Plasmodium falciparum
KESIIKNYMFLCIIKKIEENMSR

SEQ ID NO: 3385820 - protein, 29 aa, Plasmodium falciparum
KESINYIRSLPFEYKPYAILNILQHLDSD

SEQ ID NO: 3385821 - protein, 25 aa, Plasmodium falciparum
KESLDLYFKALKILKKLKDNNNNKI

SEQ ID NO: 3385822 - protein, 25 aa, Plasmodium falciparum
KESLDLYFKALKILKKLKDNNNNNK

SEQ ID NO: 3385823 - protein, 31 aa, Plasmodium falciparum
KESNLDAEQLWYLIECLIKKKNLNNLLEFFK

SEQ ID NO: 3385824 - protein, 26 aa, Plasmodium falciparum
KESVCNYFVFIYYTSKMKAPVLEDNF

SEQ ID NO: 3385825 - protein, 19 aa, Plasmodium falciparum
KETALSFLNLGYETYIVED

SEQ ID NO: 3385826 - protein, 34 aa, Plasmodium falciparum
KETIEAFNLFFMNNFFPHIILGLNNGRILLYNHE

SEQ ID NO: 3385827 - protein, 19 aa, Plasmodium falciparum
KETKIRKGMLFFSDNDTDK

SEQ ID NO: 3385828 - protein, 25 aa, Plasmodium falciparum
KETKKKAFFNFITPGSLIKQACNKH

SEQ ID NO: 3385829 - protein, 26 aa, Plasmodium falciparum
KETNDPLILHPSTSYIRNIVIKKPSN

SEQ ID NO: 3385830 - protein, 44 aa, Plasmodium falciparum
KETTEFGRNFLLKLFFFLGRYFNSKSIFMYKYISRIFEDKEESL

SEQ ID NO: 3385831 - protein, 18 aa, Plasmodium falciparum
KEVLIMYGSIRTCDKKNI

SEQ ID NO: 3385832 - protein, 30 aa, Plasmodium falciparum
KEVLKEAIIFPLKFPKLFNSSTLPYKGILL

SEQ ID NO: 3385833 - protein, 18 aa, Plasmodium falciparum
KEVLQKRFNFLEKEMIVP

SEQ ID NO: 3385834 - protein, 17 aa, Plasmodium falciparum
KEVTFFDYTLPEPVPKL

SEQ ID NO: 3385835 - protein, 21 aa, Plasmodium falciparum
KEVWDFLPPIIRDQLLMDRES

SEQ ID NO: 3385836 - protein, 22 aa, Plasmodium falciparum
KEVYTFVYNEKISNFFWYYSDV

SEQ ID NO: 3385837 - protein, 36 aa, Plasmodium falciparum
KEWISKIRNNIFLPNSVWLSALFNPISFLTAIKQKF

SEQ ID NO: 3385838 - protein, 20 aa, Plasmodium falciparum
KEYEMVIHLFLSSKNYLKII

SEQ ID NO: 3385839 - protein, 26 aa, Plasmodium falciparum
KEYHIKINYLLNLFYTSYIPEENKRN

SEQ ID NO: 3385840 - protein, 17 aa, Plasmodium falciparum
KEYNFLKELYRIQNNEQ

SEQ ID NO: 3385841 - protein, 33 aa, Plasmodium falciparum
KEYNNIYHILKLVNLPFLVPTLTEIYFIHFFND

SEQ ID NO: 3385842 - protein, 17 aa, Plasmodium falciparum
KEYTKQVLLNSKALAEC

SEQ ID NO: 3385843 - protein, 21 aa, Plasmodium falciparum
KFAKLFYDNYSNLFYCMHLHN

SEQ ID NO: 3385844 - protein, 18 aa, Plasmodium falciparum
KFCFINYADAESAKNAMD

SEQ ID NO: 3385845 - protein, 31 aa, Plasmodium falciparum
KFCKKRFMFFDFYHHFNIFIKKYISLKNKES

SEQ ID NO: 3385846 - protein, 19 aa, Plasmodium falciparum
KFCNVNVPIQARCIAVNPI

SEQ ID NO: 3385847 - protein, 19 aa, Plasmodium falciparum
KFDEKMIDLILNNGNKCYQ

SEQ ID NO: 3385848 - protein, 23 aa, Plasmodium falciparum
KFDIPVIFVLNKADIYGSNESIV

SEQ ID NO: 3385849 - protein, 34 aa, Plasmodium falciparum
KFDIRLYVLILSYYPLTIYIYRSGFARFSHTYFK

SEQ ID NO: 3385850 - protein, 20 aa, Plasmodium falciparum
KFDLIRRRNRKKSINFNYNN

SEQ ID NO: 3385851 - protein, 29 aa, Plasmodium falciparum
KFDQIFFSEDFITYDFQWVETDGVVSSYA

SEQ ID NO: 3385852 - protein, 20 aa, Plasmodium falciparum
KFDRGYISPYFINNSKDQKV

SEQ ID NO: 3385853 - protein, 23 aa, Plasmodium falciparum
KFDRRFLRVFANTSKLSEFLHPQ

SEQ ID NO: 3385854 - protein, 21 aa, Plasmodium falciparum
KFDTISRMFLSLESTYHTALN

SEQ ID NO: 3385855 - protein, 30 aa, Plasmodium falciparum
KFDYNKSFDILFPPYDNKDVYMYWNNKKND

SEQ ID NO: 3385856 - protein, 17 aa, Plasmodium falciparum
KFEDKLQIFREDELLIG

SEQ ID NO: 3385857 - protein, 18 aa, Plasmodium falciparum
KFEIPIEKVFNRSLRLKF

SEQ ID NO: 3385858 - protein, 17 aa, Plasmodium falciparum
KFFENSYIKLSKSTLKN

SEQ ID NO: 3385859 - protein, 20 aa, Plasmodium falciparum
KFFNPGKLRYDPMGPFGNEP

SEQ ID NO: 3385860 - protein, 19 aa, Plasmodium falciparum
KFFSKSQSLIGVYKNKHKK

SEQ ID NO: 3385861 - protein, 25 aa, Plasmodium falciparum
KFFSSVTFLDILYEFNVFNVKRDGH

SEQ ID NO: 3385862 - protein, 23 aa, Plasmodium falciparum
KFHSKIYDLILQPIRNKFGGCIR

SEQ ID NO: 3385863 - protein, 26 aa, Plasmodium falciparum
KFIGENYVYILLENGTYHCYPIHLLK

SEQ ID NO: 3385864 - protein, 30 aa, Plasmodium falciparum
KFIHDQRIYTYIKLVLLWKRDINIKCIIDN

SEQ ID NO: 3385865 - protein, 17 aa, Plasmodium falciparum
KFIITDENIKWLILTHD

SEQ ID NO: 3385866 - protein, 18 aa, Plasmodium falciparum
KFILFVSGLYINELNKSI

SEQ ID NO: 3385867 - protein, 20 aa, Plasmodium falciparum
KFIMPQGDLITYLNIYNKWK

SEQ ID NO: 3385868 - protein, 18 aa, Plasmodium falciparum
KFIPLVDIPLLGNKNNLL

SEQ ID NO: 3385869 - protein, 18 aa, Plasmodium falciparum
KFIPRIYINDFKLIKKEN

SEQ ID NO: 3385870 - protein, 48 aa, Plasmodium falciparum
KFKEDMILNHDIDCWPIVDCLIAFYSTGFPLKKAIEYVKKYKPITLNN

SEQ ID NO: 3385871 - protein, 17 aa, Plasmodium falciparum
KFKEFHKLCKIKKLAVT

SEQ ID NO: 3385872 - protein, 17 aa, Plasmodium falciparum
KFKGFNFCISSNKNNLE

SEQ ID NO: 3385873 - protein, 20 aa, Plasmodium falciparum
KFKIERLLKSSYKKCIYLLF

SEQ ID NO: 3385874 - protein, 17 aa, Plasmodium falciparum
KFKIYYTLPKHTNLKYI

SEQ ID NO: 3385875 - protein, 24 aa, Plasmodium falciparum
KFKKSSIIFLIQLELFLTSDENIN

SEQ ID NO: 3385876 - protein, 17 aa, Plasmodium falciparum
KFKKYKSISIFIENLDR

SEQ ID NO: 3385877 - protein, 24 aa, Plasmodium falciparum
KFKLDPPFLFIVPSSQNFPTMNIF

SEQ ID NO: 3385878 - protein, 21 aa, Plasmodium falciparum
KFKNFFNKKNMNKSGPFYSYM

SEQ ID NO: 3385879 - protein, 19 aa, Plasmodium falciparum
KFKNFFYYNNINSFDLTLL

SEQ ID NO: 3385880 - protein, 18 aa, Plasmodium falciparum
KFKNFNNNFINYIGDIRN

SEQ ID NO: 3385881 - protein, 23 aa, Plasmodium falciparum
KFKNLLFQPNRLPDIFIYPSFTN

SEQ ID NO: 3385882 - protein, 18 aa, Plasmodium falciparum
KFLFIHMNNNILKDEKKL

SEQ ID NO: 3385883 - protein, 17 aa, Plasmodium falciparum
KFLHKIIKVLEEAKYNE

SEQ ID NO: 3385884 - protein, 26 aa, Plasmodium falciparum
KFLLDSHKFNKLLELLRINEKEYLMN

SEQ ID NO: 3385885 - protein, 20 aa, Plasmodium falciparum
KFLYVDWKHLIYSKAPKSVK

SEQ ID NO: 3385886 - protein, 21 aa, Plasmodium falciparum
KFNGVPVNFLDNPHIDKKIIL

SEQ ID NO: 3385887 - protein, 17 aa, Plasmodium falciparum
KFNHNFIIYNDREEGVN

SEQ ID NO: 3385888 - protein, 21 aa, Plasmodium falciparum
KFNIPSFIEKWKGSLAYIGNH

SEQ ID NO: 3385889 - protein, 24 aa, Plasmodium falciparum
KFNKKERYPMKYPEFDGTTNETMM

SEQ ID NO: 3385890 - protein, 32 aa, Plasmodium falciparum
KFNKKMNYLLKKEDFYIYRQNFNFFPKELEVQ

SEQ ID NO: 3385891 - protein, 33 aa, Plasmodium falciparum
KFNKQNKIIRWNLPRPYFLDKINLFNNYMHNEY

SEQ ID NO: 3385892 - protein, 18 aa, Plasmodium falciparum
KFNNILMTSGYDGYIRLY

SEQ ID NO: 3385893 - protein, 26 aa, Plasmodium falciparum
KFPPNTFDALYYVLPGLSFHGYPEFI

SEQ ID NO: 3385894 - protein, 20 aa, Plasmodium falciparum
KFPVLPFHVKHLEDQRAALI

SEQ ID NO: 3385895 - protein, 24 aa, Plasmodium falciparum
KFQDTYKIYENSTSCLYINNNYET

SEQ ID NO: 3385896 - protein, 18 aa, Plasmodium falciparum
KFQSFIDFYISKHVQKIL

SEQ ID NO: 3385897 - protein, 21 aa, Plasmodium falciparum
KFRCLILVPTRELALQILKHF

SEQ ID NO: 3385898 - protein, 38 aa, Plasmodium falciparum
KFRLYIEHYFLYCNTFEFPKWIQPQYIRDINLRTPDHA

SEQ ID NO: 3385899 - protein, 24 aa, Plasmodium falciparum
KFSGDAVLVIWPLHNVLKNKKKKK

SEQ ID NO: 3385900 - protein, 18 aa, Plasmodium falciparum
KFSIFKKDTPLNKKEDSA

SEQ ID NO: 3385901 - protein, 46 aa, Plasmodium falciparum
KFSKDELYKTFIYSNFLTKALILYPSLMPYVECIIEKIKKIKNENI

SEQ ID NO: 3385902 - protein, 19 aa, Plasmodium falciparum
KFSLCLWDSDVFLYKDKTS

SEQ ID NO: 3385903 - protein, 28 aa, Plasmodium falciparum
KFSTSVRSLLLAMLNINPQNRLSLDEVM

SEQ ID NO: 3385904 - protein, 25 aa, Plasmodium falciparum
KFSYKDLELILFSLGSYNILRNAVF

SEQ ID NO: 3385905 - protein, 18 aa, Plasmodium falciparum
KFTCCLIACYIYQIKIDV

SEQ ID NO: 3385906 - protein, 19 aa, Plasmodium falciparum
KFTFLDTPGHKVFQIFRGR

SEQ ID NO: 3385907 - protein, 22 aa, Plasmodium falciparum
KFTNFFLEKFILIFENQANTLD

SEQ ID NO: 3385908 - protein, 20 aa, Plasmodium falciparum
KFVSNKWLQYNNKDIVGLLG

SEQ ID NO: 3385909 - protein, 26 aa, Plasmodium falciparum
KFVSWHINTLYKKNLIYYGSRVTIFS

SEQ ID NO: 3385910 - protein, 27 aa, Plasmodium falciparum
KFWKRYIYLWINYSIFEELYAQNIQRA

SEQ ID NO: 3385911 - protein, 28 aa, Plasmodium falciparum
KFYCIKTNLYHLYLSVPFYVIINDENIN

SEQ ID NO: 3385912 - protein, 17 aa, Plasmodium falciparum
KFYKHKVFYTRNDFLKL

SEQ ID NO: 3385913 - protein, 18 aa, Plasmodium falciparum
KFYNLDYDKETVSKTSCF

SEQ ID NO: 3385914 - protein, 24 aa, Plasmodium falciparum
KFYNNFLFKIPTGMGKTLIYDILI

SEQ ID NO: 3385915 - protein, 17 aa, Plasmodium falciparum
KFYPYFEWNDSNSCFFS

SEQ ID NO: 3385916 - protein, 18 aa, Plasmodium falciparum
KFYQIQKIIFNNGLIDMK

SEQ ID NO: 3385917 - protein, 21 aa, Plasmodium falciparum
KFYVIRKDRFLLKYPQGSNII

SEQ ID NO: 3385918 - protein, 20 aa, Plasmodium falciparum
KGANYFVYKLDGPKFSSDRC

SEQ ID NO: 3385919 - protein, 18 aa, Plasmodium falciparum
KGCILQNIKMKEGIIINK

SEQ ID NO: 3385920 - protein, 32 aa, Plasmodium falciparum
KGCRVYVGNLPWKVTWPILKNHMKKAGDVVRV

SEQ ID NO: 3385921 - protein, 23 aa, Plasmodium falciparum
KGDDYFMKAYKYTQPNKIIDYSS

SEQ ID NO: 3385922 - protein, 17 aa, Plasmodium falciparum
KGDILVFLPGQYEIELV

SEQ ID NO: 3385923 - protein, 20 aa, Plasmodium falciparum
KGDSFLITYIGYNNSEYVST

SEQ ID NO: 3385924 - protein, 23 aa, Plasmodium falciparum
KGEHIYFYNKYIMSDNKPIYNNI

SEQ ID NO: 3385925 - protein, 24 aa, Plasmodium falciparum
KGEKNDIHICGEKYIYNNIKQKKD

SEQ ID NO: 3385926 - protein, 25 aa, Plasmodium falciparum
KGESYEQIDSLNWEYSYDSNNLNNS

SEQ ID NO: 3385927 - protein, 22 aa, Plasmodium falciparum
KGEYMDGISSVPFLSDGKSIVY

SEQ ID NO: 3385928 - protein, 25 aa, Plasmodium falciparum
KGFDHLHKYYKSNGSINIPSHPNLH

SEQ ID NO: 3385929 - protein, 26 aa, Plasmodium falciparum
KGFDITKFIFLNYYLNSSENLNEVNM

SEQ ID NO: 3385930 - protein, 17 aa, Plasmodium falciparum
KGFFKNVKFTKFYNFFN

SEQ ID NO: 3385931 - protein, 24 aa, Plasmodium falciparum
KGFHKLICFSFDKKGELWAINLKK

SEQ ID NO: 3385932 - protein, 20 aa, Plasmodium falciparum
KGFVISKIDLLYFEKKKKKY

SEQ ID NO: 3385933 - protein, 24 aa, Plasmodium falciparum
KGGFQIPIFVKWMKLYDKKDMGSY

SEQ ID NO: 3385934 - protein, 25 aa, Plasmodium falciparum
KGGIVDKLNCRCTIIGASNFEINKE

SEQ ID NO: 3385935 - protein, 25 aa, Plasmodium falciparum
KGGNILKIGIILSGGPAPGGHNVIS

SEQ ID NO: 3385936 - protein, 19 aa, Plasmodium falciparum
KGIIPLLILCLQEKDNNLI

SEQ ID NO: 3385937 - protein, 22 aa, Plasmodium falciparum
KGIRHLINILLHTNKSITTFEI

SEQ ID NO: 3385938 - protein, 21 aa, Plasmodium falciparum
KGISMPLGGWYLKNEKQKKKN

SEQ ID NO: 3385939 - protein, 19 aa, Plasmodium falciparum
KGIYKLIELRTNEKKIKNL

SEQ ID NO: 3385940 - protein, 27 aa, Plasmodium falciparum
KGKESIALMYWLLAQEVLYLKGVIPRS

SEQ ID NO: 3385941 - protein, 32 aa, Plasmodium falciparum
KGKGKVFMKKGIPKLMMKFNAFSTKKMGINNL

SEQ ID NO: 3385942 - protein, 32 aa, Plasmodium falciparum
KGKKEIIICRVFLQFLQILINLICEKYEPVED

SEQ ID NO: 3385943 - protein, 31 aa, Plasmodium falciparum
KGKKFIIDGTFFIYKFMYVAWKHIINDKNRD

SEQ ID NO: 3385944 - protein, 27 aa, Plasmodium falciparum
KGKKKEIKLILLNAENKMTLCFDEKDK

SEQ ID NO: 3385945 - protein, 26 aa, Plasmodium falciparum
KGKKKTFVQWLMDERKRRLKNNLPID

SEQ ID NO: 3385946 - protein, 27 aa, Plasmodium falciparum
KGKKLLRYLDISLNNKSLHDSHILELV

SEQ ID NO: 3385947 - protein, 17 aa, Plasmodium falciparum
KGKKYIVCYNYLGKIQV

SEQ ID NO: 3385948 - protein, 25 aa, Plasmodium falciparum
KGKLRYYHNSIYWNYGALPQTYEYP

SEQ ID NO: 3385949 - protein, 24 aa, Plasmodium falciparum
KGKPFLNQVPLMSTSKKKINHIYN

SEQ ID NO: 3385950 - protein, 31 aa, Plasmodium falciparum
KGKRILRHLYRSKLIVYVIDVSNDKLKNVDD

SEQ ID NO: 3385951 - protein, 21 aa, Plasmodium falciparum
KGKRNVILFVGLQGSGKTTTC

SEQ ID NO: 3385952 - protein, 22 aa, Plasmodium falciparum
KGKTLYDFIYKKGYNKNEINDK

SEQ ID NO: 3385953 - protein, 25 aa, Plasmodium falciparum
KGKVDIPEIIFKKLPMNINADNIIE

SEQ ID NO: 3385954 - protein, 25 aa, Plasmodium falciparum
KGKVLLPVFALGRAQELLLILEEHW

SEQ ID NO: 3385955 - protein, 23 aa, Plasmodium falciparum
KGKYILEKALLSFLVIDHHGKEH

SEQ ID NO: 3385956 - protein, 29 aa, Plasmodium falciparum
KGLCIFDMLNIPLYHGWVISSDDIIFYSY

SEQ ID NO: 3385957 - protein, 25 aa, Plasmodium falciparum
KGLNIIKLINTLLLIEFRNLHKNGI

SEQ ID NO: 3385958 - protein, 19 aa, Plasmodium falciparum
KGLPPGVPQLPFPPNVNPP

SEQ ID NO: 3385959 - protein, 20 aa, Plasmodium falciparum
KGMGFTDVEKCLKALIKSKG

SEQ ID NO: 3385960 - protein, 19 aa, Plasmodium falciparum
KGMKCYRPRKKGERKRKSV

SEQ ID NO: 3385961 - protein, 30 aa, Plasmodium falciparum
KGMRMLEGANINRSLLALGNVINALVLRSK

SEQ ID NO: 3385962 - protein, 34 aa, Plasmodium falciparum
KGNIKYYNDCAHILRAMFLAKLEEKYNIIPRDLA

SEQ ID NO: 3385963 - protein, 26 aa, Plasmodium falciparum
KGNKRRIMNITNIFKIYNLKNNNENN

SEQ ID NO: 3385964 - protein, 21 aa, Plasmodium falciparum
KGNLHFFMKDYYKALQAYNKG

SEQ ID NO: 3385965 - protein, 17 aa, Plasmodium falciparum
KGNMYYTNLWIENKKMD

SEQ ID NO: 3385966 - protein, 26 aa, Plasmodium falciparum
KGNSMELFVNVLNWAIPKTEVNEMLK

SEQ ID NO: 3385967 - protein, 17 aa, Plasmodium falciparum
KGPELFILQGMIFLKMK

SEQ ID NO: 3385968 - protein, 24 aa, Plasmodium falciparum
KGPFHKPIIYTSRAKSLIAQNSRN

SEQ ID NO: 3385969 - protein, 41 aa, Plasmodium falciparum
KGPGCGLWAPLWRVWIFFLRGVIPLLERWLSNLLARQFEGR

SEQ ID NO: 3385970 - protein, 26 aa, Plasmodium falciparum
KGQPARLMWSHRDPSLRKSGTGNIFV

SEQ ID NO: 3385971 - protein, 25 aa, Plasmodium falciparum
KGRGTPPCYIGIILGTGSNGCYYEP

SEQ ID NO: 3385972 - protein, 33 aa, Plasmodium falciparum
KGRKISYNINLPKYNFNAKRTSSAWFLNPAYEN

SEQ ID NO: 3385973 - protein, 21 aa, Plasmodium falciparum
KGRVIDAPLFHSAPDNDINHT

SEQ ID NO: 3385974 - protein, 27 aa, Plasmodium falciparum
KGRVTSMEWLGDLLFSASWDQTIKCWN

SEQ ID NO: 3385975 - protein, 26 aa, Plasmodium falciparum
KGSCNPCANYFFHFSGCSKGNQCTKC

SEQ ID NO: 3385976 - protein, 31 aa, Plasmodium falciparum
KGSGRHLRVFSVKKYGYKKAKMLAIECKNSV

SEQ ID NO: 3385977 - protein, 33 aa, Plasmodium falciparum
KGSIKYAHLMCLRKWINGRLNLNDQLFSGSVFI

SEQ ID NO: 3385978 - protein, 25 aa, Plasmodium falciparum
KGSKKFVYLYIDFDNYFLNASIRNK

SEQ ID NO: 3385979 - protein, 29 aa, Plasmodium falciparum
KGSRFDIPILESLRWIFKHVAKTHLKKSS

SEQ ID NO: 3385980 - protein, 23 aa, Plasmodium falciparum
KGSSIYIEILNKTYNITKNIDII

SEQ ID NO: 3385981 - protein, 28 aa, Plasmodium falciparum
KGTVTFLNELRYLFKSFRSQVVLKNRIN

SEQ ID NO: 3385982 - protein, 26 aa, Plasmodium falciparum
KGVDQSPIITWGKIICTPKLVHGQKD

SEQ ID NO: 3385983 - protein, 20 aa, Plasmodium falciparum
KGVLLYGPPGTGKTLLARAM

SEQ ID NO: 3385984 - protein, 27 aa, Plasmodium falciparum
KGVQHPLRGLFLRYFLIQMCKDRIPDT

SEQ ID NO: 3385985 - protein, 46 aa, Plasmodium falciparum
KGVSYNDRKGSWLAYWSIGKNFQMRRFPIKKLGFEKAKELAIQCRL

SEQ ID NO: 3385986 - protein, 22 aa, Plasmodium falciparum
KGVYFSKSPRGVGKWNAYFQIA

SEQ ID NO: 3385987 - protein, 43 aa, Plasmodium falciparum
KGYNNCDVYYVFKYLLLPILEKFRPEFIFISCGFDASINDPLG

SEQ ID NO: 3385988 - protein, 20 aa, Plasmodium falciparum
KHALIRINKRNIIYLNATRY

SEQ ID NO: 3385989 - protein, 29 aa, Plasmodium falciparum
KHDDFVNIYLNLFFQARKNAILSDSQREE

SEQ ID NO: 3385990 - protein, 19 aa, Plasmodium falciparum
KHEDTKIKRVYYKNSFELP

SEQ ID NO: 3385991 - protein, 19 aa, Plasmodium falciparum
KHFNVFKYKLYFHYEKKEK

SEQ ID NO: 3385992 - protein, 25 aa, Plasmodium falciparum
KHGTFNYFLLLKRIVNKQLKNTLFL

SEQ ID NO: 3385993 - protein, 22 aa, Plasmodium falciparum
KHIAESPYLLEIKPSEAYAANC

SEQ ID NO: 3385994 - protein, 20 aa, Plasmodium falciparum
KHIEPNAKIFFPKKNNKKQG

SEQ ID NO: 3385995 - protein, 28 aa, Plasmodium falciparum
KHIFENSFELHLLIDYKKKLEDLLESTE

SEQ ID NO: 3385996 - protein, 26 aa, Plasmodium falciparum
KHIGDFMFIILSDDKKIYFLKDKEVY

SEQ ID NO: 3385997 - protein, 18 aa, Plasmodium falciparum
KHIIFQEHKIYISDEDDC

SEQ ID NO: 3385998 - protein, 20 aa, Plasmodium falciparum
KHINKYSTVLLLLDNIPQHD

SEQ ID NO: 3385999 - protein, 31 aa, Plasmodium falciparum
KHKIKNISLGSFHTLLLTYDGYVFTFGCNKR

SEQ ID NO: 3386000 - protein, 17 aa, Plasmodium falciparum
KHKKSFLQSVKKKRIKK

SEQ ID NO: 3386001 - protein, 29 aa, Plasmodium falciparum
KHKNILICSFTYCIYIYKLNISGNEKIDL

SEQ ID NO: 3386002 - protein, 25 aa, Plasmodium falciparum
KHKNLEIHILYLNIITLDISFNNLE

SEQ ID NO: 3386003 - protein, 35 aa, Plasmodium falciparum
KHKNNEYNFLIFFDIKYFLIFKDIINDPEAYNNPH

SEQ ID NO: 3386004 - protein, 29 aa, Plasmodium falciparum
KHLAKKALIIYLRHLYIVMKFKDIKKKIQ

SEQ ID NO: 3386005 - protein, 30 aa, Plasmodium falciparum
KHLLYNDTIKMDYLLNRKIEYEKLDEDQSE

SEQ ID NO: 3386006 - protein, 17 aa, Plasmodium falciparum
KHLTVYKIIQYAHALKS

SEQ ID NO: 3386007 - protein, 23 aa, Plasmodium falciparum
KHMNNFLKNACKYAMDNMFGDEN

SEQ ID NO: 3386008 - protein, 19 aa, Plasmodium falciparum
KHNCKFLIIINEKQKNYIG

SEQ ID NO: 3386009 - protein, 28 aa, Plasmodium falciparum
KHNGKVYNRFINRCFKRKLYHHEHEKNE

SEQ ID NO: 3386010 - protein, 22 aa, Plasmodium falciparum
KHNHDNFFIAKLIKRSDAVFTN

SEQ ID NO: 3386011 - protein, 28 aa, Plasmodium falciparum
KHNINSEILFFKNTYLMIKRAVNRDLIK

SEQ ID NO: 3386012 - protein, 20 aa, Plasmodium falciparum
KHNMTIILISSIMTWSKTKR

SEQ ID NO: 3386013 - protein, 30 aa, Plasmodium falciparum
KHNNYHAKWKLINDLDLVILIVYQGIQNST

SEQ ID NO: 3386014 - protein, 26 aa, Plasmodium falciparum
KHNPDIRYQLVALMAFFGTTSAITCY

SEQ ID NO: 3386015 - protein, 23 aa, Plasmodium falciparum
KHNRLFMKAYPLAEGLPEAIDKN

SEQ ID NO: 3386016 - protein, 25 aa, Plasmodium falciparum
KHNRLGNLLVWNVKDKNILCSFKIK

SEQ ID NO: 3386017 - protein, 18 aa, Plasmodium falciparum
KHPLIKFTYNMQADLERK

SEQ ID NO: 3386018 - protein, 33 aa, Plasmodium falciparum
KHQPIDPNDIPLKLYIGGLLGPLSNITEQELKQ

SEQ ID NO: 3386019 - protein, 17 aa, Plasmodium falciparum
KHQSLGIELLHFGEVIM

SEQ ID NO: 3386020 - protein, 25 aa, Plasmodium falciparum
KHSDRLKRKIPKHYSSKNKDNNLND

SEQ ID NO: 3386021 - protein, 27 aa, Plasmodium falciparum
KHSEEIILFVELMMPALKIPCFANGTQ

SEQ ID NO: 3386022 - protein, 21 aa, Plasmodium falciparum
KHSLLNIKIVDFGLSSFFSKD

SEQ ID NO: 3386023 - protein, 27 aa, Plasmodium falciparum
KHSNYYNPLFLCKVLITLGEGILVQHP

SEQ ID NO: 3386024 - protein, 25 aa, Plasmodium falciparum
KHSVKSYNPLTYSFSGLCECLSKQD

SEQ ID NO: 3386025 - protein, 20 aa, Plasmodium falciparum
KHSYEFYKNKILKIYDNGVQ

SEQ ID NO: 3386026 - protein, 25 aa, Plasmodium falciparum
KHTYINCYVIPMDLLEEAKIYFKKN

SEQ ID NO: 3386027 - protein, 19 aa, Plasmodium falciparum
KHVEYGILPLLHNYPLYTE

SEQ ID NO: 3386028 - protein, 19 aa, Plasmodium falciparum
KHVFIDMPKKHSLIIKLPL

SEQ ID NO: 3386029 - protein, 20 aa, Plasmodium falciparum
KHWRLIGWGQINKGKPLELQ

SEQ ID NO: 3386030 - protein, 20 aa, Plasmodium falciparum
KHYGKCVILFGIPYQYTLSK

SEQ ID NO: 3386031 - protein, 20 aa, Plasmodium falciparum
KHYNLKYKDPEFLKPIICRS

SEQ ID NO: 3386032 - protein, 20 aa, Plasmodium falciparum
KIAENVSDNPWWAKGQSKIK

SEQ ID NO: 3386033 - protein, 20 aa, Plasmodium falciparum
KIAILTCPFEPPKPKIKHKL

SEQ ID NO: 3386034 - protein, 26 aa, Plasmodium falciparum
KIANLKRRARELAQRYKSKEYSNHDQ

SEQ ID NO: 3386035 - protein, 21 aa, Plasmodium falciparum
KIAPGMLFNFKIEFYPKSHAN

SEQ ID NO: 3386036 - protein, 18 aa, Plasmodium falciparum
KICDKIIYIPQYGKGTAS

SEQ ID NO: 3386037 - protein, 24 aa, Plasmodium falciparum
KICELCNIIYPIFNKIFGNGFVGD

SEQ ID NO: 3386038 - protein, 23 aa, Plasmodium falciparum
KICHDLFDPLYFEYNKGYKKIMN

SEQ ID NO: 3386039 - protein, 19 aa, Plasmodium falciparum
KICKNVFTHFRWKPGENSR

SEQ ID NO: 3386040 - protein, 26 aa, Plasmodium falciparum
KICLLNLYFIKMEKPSIYFMNNKIKK

SEQ ID NO: 3386041 - protein, 19 aa, Plasmodium falciparum
KICQIYQIMKLQHGVMLVG

SEQ ID NO: 3386042 - protein, 19 aa, Plasmodium falciparum
KIDGILNQFLEKHFLSSHD

SEQ ID NO: 3386043 - protein, 17 aa, Plasmodium falciparum
KIDKSKLIFFIIDERYK

SEQ ID NO: 3386044 - protein, 22 aa, Plasmodium falciparum
KIDLINYNLSFNNNIKSDCFKN

SEQ ID NO: 3386045 - protein, 42 aa, Plasmodium falciparum
KIDNELIQILTYLKFLGPSKIQAYALPIILSSNKNLIAQSQN

SEQ ID NO: 3386046 - protein, 18 aa, Plasmodium falciparum
KIDNFLNVKLKSFYNAEN

SEQ ID NO: 3386047 - protein, 31 aa, Plasmodium falciparum
KIDNYALGMNMILFISGRFVCRQKGIECSKV

SEQ ID NO: 3386048 - protein, 31 aa, Plasmodium falciparum
KIDPLLREYIYFLHSFDPYRFTFKRLSERYL

SEQ ID NO: 3386049 - protein, 24 aa, Plasmodium falciparum
KIDRMLNHSFLFDVLKKIVDQTFK

SEQ ID NO: 3386050 - protein, 40 aa, Plasmodium falciparum
KIDVNKIKFPLIETWINKRLIEILGFEDDILYEYCISQLK

SEQ ID NO: 3386051 - protein, 18 aa, Plasmodium falciparum
KIDVTQVDDLILKKKLKE

SEQ ID NO: 3386052 - protein, 19 aa, Plasmodium falciparum
KIDYAYNTLFPKPIDIKDT

SEQ ID NO: 3386053 - protein, 26 aa, Plasmodium falciparum
KIEALEKKLHILKLRVKCFKNGYKME

SEQ ID NO: 3386054 - protein, 25 aa, Plasmodium falciparum
KIECNDNFLWMCQIKYILTEDEIKE

SEQ ID NO: 3386055 - protein, 26 aa, Plasmodium falciparum
KIEDKYLFMCGRLVFKVFYNMKKEMI

SEQ ID NO: 3386056 - protein, 19 aa, Plasmodium falciparum
KIEELKEARLIAMVEKKKK

SEQ ID NO: 3386057 - protein, 18 aa, Plasmodium falciparum
KIEELNSLFLMWGTSENP

SEQ ID NO: 3386058 - protein, 19 aa, Plasmodium falciparum
KIEELRNIIINYNEKFDRI

SEQ ID NO: 3386059 - protein, 21 aa, Plasmodium falciparum
KIEKIFFKEGNSPWLYAHKSL

SEQ ID NO: 3386060 - protein, 18 aa, Plasmodium falciparum
KIEKKNPPILIKTNNTDN

SEQ ID NO: 3386061 - protein, 29 aa, Plasmodium falciparum
KIELLYPKNYYITIFPNIYFKNIIDFLKS

SEQ ID NO: 3386062 - protein, 27 aa, Plasmodium falciparum
KIELPVFIHSYVWKNNNWYGVIHMREC

SEQ ID NO: 3386063 - protein, 27 aa, Plasmodium falciparum
KIENLTYACTYLRIPSDTDIYYNNKKN

SEQ ID NO: 3386064 - protein, 27 aa, Plasmodium falciparum
KIEPPSQILLNTPPPPSGQPPTGIQNV

SEQ ID NO: 3386065 - protein, 25 aa, Plasmodium falciparum
KIEQKLCLIWKYGKSLITFKNIYDL

SEQ ID NO: 3386066 - protein, 18 aa, Plasmodium falciparum
KIESLMGRIIAIDASMSL

SEQ ID NO: 3386067 - protein, 22 aa, Plasmodium falciparum
KIETKIIPKYIEVPVVKIVNRY

SEQ ID NO: 3386068 - protein, 35 aa, Plasmodium falciparum
KIETKKFIIPANSKYLLIIVYLPTRHGPFEKTFII

SEQ ID NO: 3386069 - protein, 24 aa, Plasmodium falciparum
KIEYRVWNPFRSKLGACLMGGVGN

SEQ ID NO: 3386070 - protein, 17 aa, Plasmodium falciparum
KIFDRYRKAYYMNGLSS

SEQ ID NO: 3386071 - protein, 20 aa, Plasmodium falciparum
KIFEKLFFETFENYIKKYIN

SEQ ID NO: 3386072 - protein, 28 aa, Plasmodium falciparum
KIFEYIRLIDIYFRILYEYNGINKLCGG

SEQ ID NO: 3386073 - protein, 19 aa, Plasmodium falciparum
KIFFKKIINSNDIIKKMML

SEQ ID NO: 3386074 - protein, 17 aa, Plasmodium falciparum
KIFFPKKNNKKQGYAIV

SEQ ID NO: 3386075 - protein, 26 aa, Plasmodium falciparum
KIFPRLIYFTLLIKSPICIALLKNFC

SEQ ID NO: 3386076 - protein, 21 aa, Plasmodium falciparum
KIFVRNPRLSIRDINLYNIKH

SEQ ID NO: 3386077 - protein, 23 aa, Plasmodium falciparum
KIGIEPPMGILIYGPPGTGKTML

SEQ ID NO: 3386078 - protein, 32 aa, Plasmodium falciparum
KIGIINREKTCPFLLRLFYKVDKEYNVDDMDI

SEQ ID NO: 3386079 - protein, 23 aa, Plasmodium falciparum
KIGQRKLLNWIIHPIRDEKKINE

SEQ ID NO: 3386080 - protein, 28 aa, Plasmodium falciparum
KIGVHIVGKLLRKLIHDVTYYRDEEERN

SEQ ID NO: 3386081 - protein, 24 aa, Plasmodium falciparum
KIGVPWCTSLTWSANGQLLYCGST

SEQ ID NO: 3386082 - protein, 23 aa, Plasmodium falciparum
KIGYHNMMYPNVNNFPSTNYQPL

SEQ ID NO: 3386083 - protein, 20 aa, Plasmodium falciparum
KIGYPILVRTTFSLGGLNSS

SEQ ID NO: 3386084 - protein, 36 aa, Plasmodium falciparum
KIHAQKYMKFKTFPPYLFIHLKRFYADENWSAKKIN

SEQ ID NO: 3386085 - protein, 19 aa, Plasmodium falciparum
KIHENFYLFRKKEKFNNSI

SEQ ID NO: 3386086 - protein, 18 aa, Plasmodium falciparum
KIHNLYKNNLEYNNLLEK

SEQ ID NO: 3386087 - protein, 20 aa, Plasmodium falciparum
KIICIFLQYIKYQSMYFKKK

SEQ ID NO: 3386088 - protein, 19 aa, Plasmodium falciparum
KIIDDIFKYSFPDITKEDL

SEQ ID NO: 3386089 - protein, 25 aa, Plasmodium falciparum
KIIEEKYITQFLLNKYHSLEENFIN

SEQ ID NO: 3386090 - protein, 33 aa, Plasmodium falciparum
KIIERPNYVPVIKYRDIPIEKIRYVPKIETVEL

SEQ ID NO: 3386091 - protein, 21 aa, Plasmodium falciparum
KIIFRITLALFKLNQQKLCEL

SEQ ID NO: 3386092 - protein, 18 aa, Plasmodium falciparum
KIIIPLKYMLLCKVLEEN

SEQ ID NO: 3386093 - protein, 17 aa, Plasmodium falciparum
KIIISKEDKYTNTNNNS

SEQ ID NO: 3386094 - protein, 25 aa, Plasmodium falciparum
KIIKNFNMLKRNINLKVLINQMIKM

SEQ ID NO: 3386095 - protein, 25 aa, Plasmodium falciparum
KIIKNNLHIYGLKKISIILHSLTKL

SEQ ID NO: 3386096 - protein, 27 aa, Plasmodium falciparum
KIIKVNPYIRVGFACRYMRYDYPIGTD

SEQ ID NO: 3386097 - protein, 29 aa, Plasmodium falciparum
KIILLLDVIIYYKYFKEELLKVVYEYILK

SEQ ID NO: 3386098 - protein, 18 aa, Plasmodium falciparum
KIILPINKKWKIENSILY

SEQ ID NO: 3386099 - protein, 19 aa, Plasmodium falciparum
KIILTYYIWEDDKIFNNFT

SEQ ID NO: 3386100 - protein, 24 aa, Plasmodium falciparum
KIINCDIIIVLNKIDLIPLHLREK

SEQ ID NO: 3386101 - protein, 22 aa, Plasmodium falciparum
KIINHILGRDFLWIPELSMNDF

SEQ ID NO: 3386102 - protein, 19 aa, Plasmodium falciparum
KIINLKYLSKKNSLKNILR

SEQ ID NO: 3386103 - protein, 17 aa, Plasmodium falciparum
KIIPRPLGKGLKINRKY

SEQ ID NO: 3386104 - protein, 24 aa, Plasmodium falciparum
KIIQTFIKSYQFFLDFGYDKNGTN

SEQ ID NO: 3386105 - protein, 26 aa, Plasmodium falciparum
KIIYENDYFLVLNKPYDIKLEKGKLD

SEQ ID NO: 3386106 - protein, 17 aa, Plasmodium falciparum
KIIYNRLVPPRSEIYTL

SEQ ID NO: 3386107 - protein, 18 aa, Plasmodium falciparum
KIIYNYLVSYSGVVNNLK

SEQ ID NO: 3386108 - protein, 19 aa, Plasmodium falciparum
KIKEFYLQTENFMKTYENE

SEQ ID NO: 3386109 - protein, 48 aa, Plasmodium falciparum
KIKEILKLYDKLFYSHFKFIPNKIYKEILRPIYTYYQNLKSNMVGGVS

SEQ ID NO: 3386110 - protein, 33 aa, Plasmodium falciparum
KIKEKKIDLILSNNLSFFKYSCMYRKRQLLHEK

SEQ ID NO: 3386111 - protein, 18 aa, Plasmodium falciparum
KIKELEIALYLNLSICYS

SEQ ID NO: 3386112 - protein, 39 aa, Plasmodium falciparum
KIKELKILEPLKRREYFFYLYIAVSLKYVEERIANVYCV

SEQ ID NO: 3386113 - protein, 24 aa, Plasmodium falciparum
KIKELWCGRMKGLMNLKLCNMERK

SEQ ID NO: 3386114 - protein, 23 aa, Plasmodium falciparum
KIKERWKVILKNNAKRYGKISEG

SEQ ID NO: 3386115 - protein, 20 aa, Plasmodium falciparum
KIKFDDFDYNYLNELHKSVS

SEQ ID NO: 3386116 - protein, 27 aa, Plasmodium falciparum
KIKFIILYFFCVLFLKDYERSEAFNLA

SEQ ID NO: 3386117 - protein, 23 aa, Plasmodium falciparum
KIKFSKLYKDISLRISKDIDMLY

SEQ ID NO: 3386118 - protein, 25 aa, Plasmodium falciparum
KIKGIHFFFILNSKVLKELGINNKE

SEQ ID NO: 3386119 - protein, 20 aa, Plasmodium falciparum
KIKIDYKFWYTQPVPKINDE

SEQ ID NO: 3386120 - protein, 26 aa, Plasmodium falciparum
KIKIFEEMLHIFLLVGFEDTGDFYVI

SEQ ID NO: 3386121 - protein, 26 aa, Plasmodium falciparum
KIKIHNGGISFLFLHKRGKFLCSASY

SEQ ID NO: 3386122 - protein, 19 aa, Plasmodium falciparum
KIKIIASKYKKCIIPFISI

SEQ ID NO: 3386123 - protein, 27 aa, Plasmodium falciparum
KIKKIKTPLILPIDPNIELLSFLPEQS

SEQ ID NO: 3386124 - protein, 26 aa, Plasmodium falciparum
KIKKNYINLLFLINKKYGSTFTFINN

SEQ ID NO: 3386125 - protein, 29 aa, Plasmodium falciparum
KIKKRIPKIDFLVLININSDNYNNIIESH

SEQ ID NO: 3386126 - protein, 20 aa, Plasmodium falciparum
KIKKYGYEILKVFHSSYQDK

SEQ ID NO: 3386127 - protein, 25 aa, Plasmodium falciparum
KIKKYMWNQYYFNVKEKKILKIPNE

SEQ ID NO: 3386128 - protein, 20 aa, Plasmodium falciparum
KIKKYQLINENLQDCIAGYQ

SEQ ID NO: 3386129 - protein, 21 aa, Plasmodium falciparum
KIKLFKHASFLNHSCFPNASY

SEQ ID NO: 3386130 - protein, 18 aa, Plasmodium falciparum
KIKLMKYIELYNIKIEIN

SEQ ID NO: 3386131 - protein, 20 aa, Plasmodium falciparum
KIKLNIYYYQSVGDLYEINH

SEQ ID NO: 3386132 - protein, 25 aa, Plasmodium falciparum
KIKNELVYIILKKALHILQKEKNIH

SEQ ID NO: 3386133 - protein, 27 aa, Plasmodium falciparum
KIKNENITFFPAIEQFNFSIEHAVSSY

SEQ ID NO: 3386134 - protein, 25 aa, Plasmodium falciparum
KIKNILIEKFLKKNMQTLYKNLYPW

SEQ ID NO: 3386135 - protein, 17 aa, Plasmodium falciparum
KIKNRLLYDENFENNSD

SEQ ID NO: 3386136 - protein, 30 aa, Plasmodium falciparum
KIKQNVIKYNKIKSHLLSMKIKLQSVKSSE

SEQ ID NO: 3386137 - protein, 20 aa, Plasmodium falciparum
KIKTLLLPNVSLIFDWKIAD

SEQ ID NO: 3386138 - protein, 25 aa, Plasmodium falciparum
KIKVIDKPFYVNKYVDKPVVIPVSK

SEQ ID NO: 3386139 - protein, 43 aa, Plasmodium falciparum
KIKVPFNAYMFYIPLTHKPYIFLFSKKNLLQYLKTKHIPIIIE

SEQ ID NO: 3386140 - protein, 17 aa, Plasmodium falciparum
KIKYDIMNLPKVTIQIT

SEQ ID NO: 3386141 - protein, 19 aa, Plasmodium falciparum
KIKYKVFYGFKKSYENEQN

SEQ ID NO: 3386142 - protein, 21 aa, Plasmodium falciparum
KIKYLSRIYRILSIKYFHIGD

SEQ ID NO: 3386143 - protein, 18 aa, Plasmodium falciparum
KILESKFILPVKYSNIYK

SEQ ID NO: 3386144 - protein, 29 aa, Plasmodium falciparum
KILFESSFIGKYIILPWIDNDPDIKNNLY

SEQ ID NO: 3386145 - protein, 21 aa, Plasmodium falciparum
KILKDFFYDIFLFCVSKNLTI

SEQ ID NO: 3386146 - protein, 19 aa, Plasmodium falciparum
KILKLFTHICENVHFKLTR

SEQ ID NO: 3386147 - protein, 18 aa, Plasmodium falciparum
KILKMRRSLKRKRKSPKN

SEQ ID NO: 3386148 - protein, 18 aa, Plasmodium falciparum
KILKNLEPGPMAPYLTLI

SEQ ID NO: 3386149 - protein, 27 aa, Plasmodium falciparum
KILKPLGECLIKLEPYLKLIELTIDFE

SEQ ID NO: 3386150 - protein, 33 aa, Plasmodium falciparum
KILLRTRMLEARKQNIPPFQLISDQPLKDICHK

SEQ ID NO: 3386151 - protein, 20 aa, Plasmodium falciparum
KILLTIGKKIYEENICIYCF

SEQ ID NO: 3386152 - protein, 25 aa, Plasmodium falciparum
KILNIPGRLFPVEIFYTLQAEKDYV

SEQ ID NO: 3386153 - protein, 19 aa, Plasmodium falciparum
KILNIQRKTSFYLIDQNEY

SEQ ID NO: 3386154 - protein, 33 aa, Plasmodium falciparum
KILPPEIFEKIEEFIIFIGKYIDKFCSICKDME

SEQ ID NO: 3386155 - protein, 30 aa, Plasmodium falciparum
KILQKNDTILFFKKKKKFMYLRKKKKKKKK

SEQ ID NO: 3386156 - protein, 22 aa, Plasmodium falciparum
KILRNRTCIIHQILNRNKENQK

SEQ ID NO: 3386157 - protein, 22 aa, Plasmodium falciparum
KILSYPYKRPIGYITSCTWSPI

SEQ ID NO: 3386158 - protein, 20 aa, Plasmodium falciparum
KILYFHDDLIQFFNDRNIYK

SEQ ID NO: 3386159 - protein, 19 aa, Plasmodium falciparum
KIMDPIPNVYFIQGEIGKD

SEQ ID NO: 3386160 - protein, 26 aa, Plasmodium falciparum
KIMEKLIYYCFFLLKYNEKNVKNEKI

SEQ ID NO: 3386161 - protein, 32 aa, Plasmodium falciparum
KIMELNNEELKIYILIFRSLCNENIKKIDFYI

SEQ ID NO: 3386162 - protein, 19 aa, Plasmodium falciparum
KIMELTNIHIENNLDILLY

SEQ ID NO: 3386163 - protein, 19 aa, Plasmodium falciparum
KIMKNIFIALDFFHSNNII

SEQ ID NO: 3386164 - protein, 19 aa, Plasmodium falciparum
KIMVKELLNYLLVADIEIK

SEQ ID NO: 3386165 - protein, 18 aa, Plasmodium falciparum
KINDFYYFNIYLMKDQDF

SEQ ID NO: 3386166 - protein, 25 aa, Plasmodium falciparum
KINDNDLFIYEYAKKQALFIYNIIK

SEQ ID NO: 3386167 - protein, 28 aa, Plasmodium falciparum
KINEQLEMFINIHPKIFNISHAKKKRKK

SEQ ID NO: 3386168 - protein, 22 aa, Plasmodium falciparum
KINFEEILNFKLNIEKVFYESL

SEQ ID NO: 3386169 - protein, 30 aa, Plasmodium falciparum
KINFVEELFFLITQLLIHFKHNLYNSVLLS

SEQ ID NO: 3386170 - protein, 25 aa, Plasmodium falciparum
KINFYGEFISLFKKHTIISKQKIFL

SEQ ID NO: 3386171 - protein, 17 aa, Plasmodium falciparum
KINIKNIIPYMKKNNYE

SEQ ID NO: 3386172 - protein, 19 aa, Plasmodium falciparum
KINIKTFIKRDINLYSKME

SEQ ID NO: 3386173 - protein, 25 aa, Plasmodium falciparum
KINLDDFFYVFFFEKNQEVDISSSI

SEQ ID NO: 3386174 - protein, 39 aa, Plasmodium falciparum
KINLFINSACPYELLLFSSLIKCNILCNVSIRNICNSLH

SEQ ID NO: 3386175 - protein, 21 aa, Plasmodium falciparum
KINLNFCNNLFIYNIETNKCF

SEQ ID NO: 3386176 - protein, 24 aa, Plasmodium falciparum
KINLPRLKLRGLPFDASEEEIKNF

SEQ ID NO: 3386177 - protein, 20 aa, Plasmodium falciparum
KINMFFCKYNEPAYVKMEKL

SEQ ID NO: 3386178 - protein, 18 aa, Plasmodium falciparum
KINNKWNTWIDYEKFHQL

SEQ ID NO: 3386179 - protein, 31 aa, Plasmodium falciparum
KINPKRKNYIFLFKYNKFFYKMLENHREERN

SEQ ID NO: 3386180 - protein, 27 aa, Plasmodium falciparum
KINPYYAKAYYRKGCSYLLLSDLKRAS

SEQ ID NO: 3386181 - protein, 17 aa, Plasmodium falciparum
KINQINNSLLYNKQYHL

SEQ ID NO: 3386182 - protein, 17 aa, Plasmodium falciparum
KINVQNRMNLFIPINKY

SEQ ID NO: 3386183 - protein, 17 aa, Plasmodium falciparum
KINYLYLDYEKITSEQG

SEQ ID NO: 3386184 - protein, 17 aa, Plasmodium falciparum
KINYYKEKYTKIINEER

SEQ ID NO: 3386185 - protein, 23 aa, Plasmodium falciparum
KIPDNLFNDIYDFVIEKVQQQIK

SEQ ID NO: 3386186 - protein, 18 aa, Plasmodium falciparum
KIPELYIQKLGLNFSYYH

SEQ ID NO: 3386187 - protein, 19 aa, Plasmodium falciparum
KIPFISSSSKRIADQIHIH

SEQ ID NO: 3386188 - protein, 20 aa, Plasmodium falciparum
KIPMLYLSNVCNNIYYFLND

SEQ ID NO: 3386189 - protein, 26 aa, Plasmodium falciparum
KIPNILTHPYHLSSYTKLLGECSAKK

SEQ ID NO: 3386190 - protein, 19 aa, Plasmodium falciparum
KIPPFLEMLDSKGLNLKEI

SEQ ID NO: 3386191 - protein, 18 aa, Plasmodium falciparum
KIPTIYKLQLFNGKEYYV

SEQ ID NO: 3386192 - protein, 27 aa, Plasmodium falciparum
KIPVVDQREILREWKPNIIKEEKKSQK

SEQ ID NO: 3386193 - protein, 19 aa, Plasmodium falciparum
KIQCYDTLTGIKIFIVHKD

SEQ ID NO: 3386194 - protein, 27 aa, Plasmodium falciparum
KIQKARKWFYRVINLNPHFGDGWATFL

SEQ ID NO: 3386195 - protein, 31 aa, Plasmodium falciparum
KIQLKPVDFIIVNDKVIVTKILVVAKWGGEL

SEQ ID NO: 3386196 - protein, 24 aa, Plasmodium falciparum
KIRDKFKEVKLIEKSLERNNSEIY

SEQ ID NO: 3386197 - protein, 17 aa, Plasmodium falciparum
KIRLHRGLRHHWGLRVR

SEQ ID NO: 3386198 - protein, 18 aa, Plasmodium falciparum
KIRPRLLAKGFFSSMKEK

SEQ ID NO: 3386199 - protein, 37 aa, Plasmodium falciparum
KISAFPEITCVTLTPEDEFLFLACDGIWDCKDGQDVV

SEQ ID NO: 3386200 - protein, 25 aa, Plasmodium falciparum
KISDFLLKHTILVRDIRLLGDTTNK

SEQ ID NO: 3386201 - protein, 27 aa, Plasmodium falciparum
KISDKNISLIFYNLLVLASNDELDLIQ

SEQ ID NO: 3386202 - protein, 19 aa, Plasmodium falciparum
KISFEYFRNCFNDLNYDIK

SEQ ID NO: 3386203 - protein, 24 aa, Plasmodium falciparum
KISHIHLILYIYSYFNTINNTFIN

SEQ ID NO: 3386204 - protein, 24 aa, Plasmodium falciparum
KISHSYFSILSKRLLNYYINDMNR

SEQ ID NO: 3386205 - protein, 24 aa, Plasmodium falciparum
KISIQKFHLAYTNNSIGKLKIAAQ

SEQ ID NO: 3386206 - protein, 24 aa, Plasmodium falciparum
KISKKTFMCLMYNIGIQIDYCLTL

SEQ ID NO: 3386207 - protein, 18 aa, Plasmodium falciparum
KISKKVISPKKKKKLFIE

SEQ ID NO: 3386208 - protein, 21 aa, Plasmodium falciparum
KISKLLRTTTLKKSLTKDVKS

SEQ ID NO: 3386209 - protein, 32 aa, Plasmodium falciparum
KISKRNMEFKLIITKFIDGFIKCTESKIYKSS

SEQ ID NO: 3386210 - protein, 19 aa, Plasmodium falciparum
KISKVPYVINDYKKKMYQH

SEQ ID NO: 3386211 - protein, 34 aa, Plasmodium falciparum
KISLENIKDLKLKKKLRHLLRSWKLEKKDEYYKK

SEQ ID NO: 3386212 - protein, 32 aa, Plasmodium falciparum
KISLNPYEIIYLQIFGLIKNTTPIPKLNLKKI

SEQ ID NO: 3386213 - protein, 22 aa, Plasmodium falciparum
KISQKKLRYLKMKDKKEEKKKK

SEQ ID NO: 3386214 - protein, 27 aa, Plasmodium falciparum
KISSKKKYFNELLNFGNKNKNVQIKTI

SEQ ID NO: 3386215 - protein, 24 aa, Plasmodium falciparum
KISSNYIIILVANKIDKNKFQVDI

SEQ ID NO: 3386216 - protein, 24 aa, Plasmodium falciparum
KISYNKFHNFDFVNNYDLSMSSIM

SEQ ID NO: 3386217 - protein, 23 aa, Plasmodium falciparum
KITGFGLYIHYSKSKYIGYWRRG

SEQ ID NO: 3386218 - protein, 34 aa, Plasmodium falciparum
KITKRVENWRLKYPQKLYKYIKDIYPHVLNKKIS

SEQ ID NO: 3386219 - protein, 25 aa, Plasmodium falciparum
KITNYHTVLYNILSYLKRKSYIEEK

SEQ ID NO: 3386220 - protein, 23 aa, Plasmodium falciparum
KITRIRNFYMRKVKICQELFREK

SEQ ID NO: 3386221 - protein, 25 aa, Plasmodium falciparum
KITSIHFRYILLELNKILQEHNFEM

SEQ ID NO: 3386222 - protein, 21 aa, Plasmodium falciparum
KITSSNLFPQKSWKGILFGDK

SEQ ID NO: 3386223 - protein, 26 aa, Plasmodium falciparum
KITYPLNILFNEGSFFFFHDTIDKYS

SEQ ID NO: 3386224 - protein, 27 aa, Plasmodium falciparum
KIVDYDMLLILIPLIEKKPWRHQNYVF

SEQ ID NO: 3386225 - protein, 31 aa, Plasmodium falciparum
KIVEKFSSFINFPVYVLKKKKILQTRKDIEQ

SEQ ID NO: 3386226 - protein, 17 aa, Plasmodium falciparum
KIVKLCLKLSPTKDILT

SEQ ID NO: 3386227 - protein, 21 aa, Plasmodium falciparum
KIVLKYKEKYKYITLFNSIVV

SEQ ID NO: 3386228 - protein, 18 aa, Plasmodium falciparum
KIVLSKKKRKLFARIDMA

SEQ ID NO: 3386229 - protein, 18 aa, Plasmodium falciparum
KIVPLIVTVVSNFKRNIN

SEQ ID NO: 3386230 - protein, 34 aa, Plasmodium falciparum
KIVQVRLYKGIFNYPQGVLLRDNIYKLNIPIRKE

SEQ ID NO: 3386231 - protein, 27 aa, Plasmodium falciparum
KIVTSLCFYFDCLFDKSTYYIKNNTHN

SEQ ID NO: 3386232 - protein, 27 aa, Plasmodium falciparum
KIYEDKFFYIYYLYLIRKLKKENRKIC

SEQ ID NO: 3386233 - protein, 24 aa, Plasmodium falciparum
KIYEKWKYENYLKTIYHAKGNNSL

SEQ ID NO: 3386234 - protein, 25 aa, Plasmodium falciparum
KIYEQELQPLLPRFSSFNSCENYLD

SEQ ID NO: 3386235 - protein, 18 aa, Plasmodium falciparum
KIYKIYNRFVNKTDDVLC

SEQ ID NO: 3386236 - protein, 20 aa, Plasmodium falciparum
KIYKLNVMGPKKWKKEVYNI

SEQ ID NO: 3386237 - protein, 41 aa, Plasmodium falciparum
KIYKMFVEIYYMKKIIRFIIFSFFKFHDIYSVFNVNTFDGV

SEQ ID NO: 3386238 - protein, 26 aa, Plasmodium falciparum
KIYKRRYQMIFNKKLFYLFQKCEELF

SEQ ID NO: 3386239 - protein, 24 aa, Plasmodium falciparum
KIYKYGVIKLADFGFSCQLKNKRQ

SEQ ID NO: 3386240 - protein, 18 aa, Plasmodium falciparum
KIYLNIINILRNITDRIH

SEQ ID NO: 3386241 - protein, 23 aa, Plasmodium falciparum
KIYLSIYMNILYKCYNILQLHFD

SEQ ID NO: 3386242 - protein, 24 aa, Plasmodium falciparum
KIYNFYLNHKLFITCVELINEHIF

SEQ ID NO: 3386243 - protein, 35 aa, Plasmodium falciparum
KIYNTNYDYVNIRRGKNIKFVLTNCNYKTNVLKVK

SEQ ID NO: 3386244 - protein, 28 aa, Plasmodium falciparum
KIYTIELMMRSLLFSSSLVLYDEHLLKL

SEQ ID NO: 3386245 - protein, 18 aa, Plasmodium falciparum
KKAHFFASDLGGYLIQLY

SEQ ID NO: 3386246 - protein, 27 aa, Plasmodium falciparum
KKALSKYYFLIGIYYHILQNMKKALMY

SEQ ID NO: 3386247 - protein, 24 aa, Plasmodium falciparum
KKANRPYSVINVYDNLHGCINKNN

SEQ ID NO: 3386248 - protein, 29 aa, Plasmodium falciparum
KKANYLVFDILFDVFMKIIKTIGYHCKKF

SEQ ID NO: 3386249 - protein, 25 aa, Plasmodium falciparum
KKASDDLLWHKMSEQFDRNNKSILE

SEQ ID NO: 3386250 - protein, 22 aa, Plasmodium falciparum
KKCDEIYHLKTLLEKEEMNNKQ

SEQ ID NO: 3386251 - protein, 23 aa, Plasmodium falciparum
KKCDFLIKNLKDSLTKNKIIFGI

SEQ ID NO: 3386252 - protein, 25 aa, Plasmodium falciparum
KKCEKYIHLLGAQKLYKTLKLCDTQ

SEQ ID NO: 3386253 - protein, 19 aa, Plasmodium falciparum
KKCHSKFVTVLLGGKRLEQ

SEQ ID NO: 3386254 - protein, 24 aa, Plasmodium falciparum
KKCHSSDIFLIRDNILNNLSNKEF

SEQ ID NO: 3386255 - protein, 28 aa, Plasmodium falciparum
KKCIEMYIKTFLKLYKYLNINKKEEEYL

SEQ ID NO: 3386256 - protein, 23 aa, Plasmodium falciparum
KKCIIPYMLNKYSIFSFQDLCSK

SEQ ID NO: 3386257 - protein, 24 aa, Plasmodium falciparum
KKCIIRIFKYMDIYLYIYNNDEQI

SEQ ID NO: 3386258 - protein, 26 aa, Plasmodium falciparum
KKCKRIERIFSVNKYGFEGARKLAIA

SEQ ID NO: 3386259 - protein, 26 aa, Plasmodium falciparum
KKCLDELYILASYDNFLKKKYETYEC

SEQ ID NO: 3386260 - protein, 34 aa, Plasmodium falciparum
KKCMLDNSYTKYFFYIFTLDMLPSIKFETFYEKN

SEQ ID NO: 3386261 - protein, 29 aa, Plasmodium falciparum
KKCNQIIKRTLSCIPYILNNNRGAFYKKH

SEQ ID NO: 3386262 - protein, 25 aa, Plasmodium falciparum
KKCVILLGDNIIRILRFKNNLISQR

SEQ ID NO: 3386263 - protein, 22 aa, Plasmodium falciparum
KKDEEFFNHINVLKVRDNDISH

SEQ ID NO: 3386264 - protein, 22 aa, Plasmodium falciparum
KKDEILKSSSFLYFLENSSKIV

SEQ ID NO: 3386265 - protein, 28 aa, Plasmodium falciparum
KKDEKAGRKLLYLIKGLSMVHDKNTEQN

SEQ ID NO: 3386266 - protein, 20 aa, Plasmodium falciparum
KKDGIKNIIFFFKCSNGEEE

SEQ ID NO: 3386267 - protein, 24 aa, Plasmodium falciparum
KKDKFKYIDFKKSLRYNYDFYKNV

SEQ ID NO: 3386268 - protein, 32 aa, Plasmodium falciparum
KKDKKFDKYYVDKIPYPYDKNGYEKTLNININ

SEQ ID NO: 3386269 - protein, 21 aa, Plasmodium falciparum
KKDKKYIRKIYKDMKHIYNEY

SEQ ID NO: 3386270 - protein, 24 aa, Plasmodium falciparum
KKDLCLLMLLFIKCKKKCKTFIYE

SEQ ID NO: 3386271 - protein, 22 aa, Plasmodium falciparum
KKDLKVLILSKLKIFNEEEINV

SEQ ID NO: 3386272 - protein, 25 aa, Plasmodium falciparum
KKDNKDLYEHINFNNIESISNYLNN

SEQ ID NO: 3386273 - protein, 23 aa, Plasmodium falciparum
KKDNYPINTISYNKNFNLDEINK

SEQ ID NO: 3386274 - protein, 24 aa, Plasmodium falciparum
KKDNYPLVKISNGIKKKYILNNKR

SEQ ID NO: 3386275 - protein, 17 aa, Plasmodium falciparum
KKDNYYYKGDTSIYYKM

SEQ ID NO: 3386276 - protein, 27 aa, Plasmodium falciparum
KKDPNNFDFLIEPLSKEKRNSVVVEKR

SEQ ID NO: 3386277 - protein, 24 aa, Plasmodium falciparum
KKDRNKLILLNKKLNLIKIVGLVL

SEQ ID NO: 3386278 - protein, 17 aa, Plasmodium falciparum
KKDTFQLYINEKEYYIC

SEQ ID NO: 3386279 - protein, 22 aa, Plasmodium falciparum
KKDVHLFISPGTLEYLRELKNR

SEQ ID NO: 3386280 - protein, 27 aa, Plasmodium falciparum
KKDVNILLLSLFNYTIIKIIKCINFFP

SEQ ID NO: 3386281 - protein, 22 aa, Plasmodium falciparum
KKEDDMHIYSIPKSNLKKSAIQ

SEQ ID NO: 3386282 - protein, 26 aa, Plasmodium falciparum
KKEEIENFVSLFYKSKDKNKSKKSHA

SEQ ID NO: 3386283 - protein, 26 aa, Plasmodium falciparum
KKEEILKRKLLFEENKKKEYYEEMEE

SEQ ID NO: 3386284 - protein, 25 aa, Plasmodium falciparum
KKEEMIYDIFLVNNFNLDLLINEEV

SEQ ID NO: 3386285 - protein, 24 aa, Plasmodium falciparum
KKEHINEPIYYINNFNTLTNTLNS

SEQ ID NO: 3386286 - protein, 30 aa, Plasmodium falciparum
KKEIDINNMKIIFYLSNLLTKEVQNSEFIK

SEQ ID NO: 3386287 - protein, 30 aa, Plasmodium falciparum
KKEILRWVVILDYGKIFLKKICKLFVVSTN

SEQ ID NO: 3386288 - protein, 22 aa, Plasmodium falciparum
KKEKILYIPQIFNEKDYLKRIS

SEQ ID NO: 3386289 - protein, 30 aa, Plasmodium falciparum
KKEKLFEQKLPNFGGQEIPIWGGIEVPNWE

SEQ ID NO: 3386290 - protein, 30 aa, Plasmodium falciparum
KKEKLQNIIRRTQLLHILDINTYKDHINNT

SEQ ID NO: 3386291 - protein, 29 aa, Plasmodium falciparum
KKEKNLNSFLQKLGFFKNSYPVTVDSLLN

SEQ ID NO: 3386292 - protein, 23 aa, Plasmodium falciparum
KKEKSLLCPLSNNLLELSDLFSN

SEQ ID NO: 3386293 - protein, 23 aa, Plasmodium falciparum
KKELHIFMELYKYKFSDHFNSDI

SEQ ID NO: 3386294 - protein, 28 aa, Plasmodium falciparum
KKELKISLYDFIMLKKKTISTNENHKDN

SEQ ID NO: 3386295 - protein, 25 aa, Plasmodium falciparum
KKELLKMLPLIRKESSCELNNLTHS

SEQ ID NO: 3386296 - protein, 19 aa, Plasmodium falciparum
KKENYIVYKKRKDNKELKN

SEQ ID NO: 3386297 - protein, 26 aa, Plasmodium falciparum
KKEQDFLMYILRIYLHMIEVKNGEEN

SEQ ID NO: 3386298 - protein, 32 aa, Plasmodium falciparum
KKEQKLVINFNLFPFKFIDLLEECILENDNCE

SEQ ID NO: 3386299 - protein, 17 aa, Plasmodium falciparum
KKERILQMNLSNISLDY

SEQ ID NO: 3386300 - protein, 20 aa, Plasmodium falciparum
KKERLCDIISAYRSICLSQY

SEQ ID NO: 3386301 - protein, 17 aa, Plasmodium falciparum
KKESFITNILLNNKYDK

SEQ ID NO: 3386302 - protein, 27 aa, Plasmodium falciparum
KKEVEKFLNYFLLYKNNNPSNILGNFV

SEQ ID NO: 3386303 - protein, 22 aa, Plasmodium falciparum
KKEVFIIKKFDKSIPPNFFLCY

SEQ ID NO: 3386304 - protein, 23 aa, Plasmodium falciparum
KKEWCNYNTLLELEKNKMIKEKE

SEQ ID NO: 3386305 - protein, 21 aa, Plasmodium falciparum
KKEYYEKAIIILNEKIENRVL

SEQ ID NO: 3386306 - protein, 18 aa, Plasmodium falciparum
KKFAFDVYDINKDGMISN

SEQ ID NO: 3386307 - protein, 18 aa, Plasmodium falciparum
KKFAIFKAGWFQTGAKGN

SEQ ID NO: 3386308 - protein, 25 aa, Plasmodium falciparum
KKFDFPFFSIYIVENYFFEKEYKEV

SEQ ID NO: 3386309 - protein, 20 aa, Plasmodium falciparum
KKFFKNFNFCLSRSARTDQG

SEQ ID NO: 3386310 - protein, 19 aa, Plasmodium falciparum
KKFIFVSKVSTLDGTLRPN

SEQ ID NO: 3386311 - protein, 22 aa, Plasmodium falciparum
KKFINMFSKDFYSKGLFQYLNA

SEQ ID NO: 3386312 - protein, 26 aa, Plasmodium falciparum
KKFIRVLKHEFPIKNVILANNKIICS

SEQ ID NO: 3386313 - protein, 29 aa, Plasmodium falciparum
KKFKISEPKFWRCKIHTLAKNKYFDELYN

SEQ ID NO: 3386314 - protein, 20 aa, Plasmodium falciparum
KKFLINNNKLDILLKKKRNH

SEQ ID NO: 3386315 - protein, 58 aa, Plasmodium falciparum
KKFPMVQGVYFDRYQQRWSVNWIEDGKRVAKYFPIKLFGFDYARRLAIYCKIHQKIPE

SEQ ID NO: 3386316 - protein, 21 aa, Plasmodium falciparum
KKFTLLMSYFLIVQDKEITPQ

SEQ ID NO: 3386317 - protein, 34 aa, Plasmodium falciparum
KKFVDMDMHLHYMIKFFLKLHKNFFENPLETDVG

SEQ ID NO: 3386318 - protein, 27 aa, Plasmodium falciparum
KKGIIFYITINYFHLINHLKLSNLEFK

SEQ ID NO: 3386319 - protein, 31 aa, Plasmodium falciparum
KKGINSFMLINFIYILTLTNNKLELAKKLSQ

SEQ ID NO: 3386320 - protein, 24 aa, Plasmodium falciparum
KKGKFQHTYILTPKLNKSKLPERK

SEQ ID NO: 3386321 - protein, 25 aa, Plasmodium falciparum
KKGKKDLLIMLINDLTHGKIKHKKE

SEQ ID NO: 3386322 - protein, 31 aa, Plasmodium falciparum
KKGKSILFFSYDYYMPQKLKFAKELIKLLNK

SEQ ID NO: 3386323 - protein, 21 aa, Plasmodium falciparum
KKGLLITYPIYENKKLKYILD

SEQ ID NO: 3386324 - protein, 26 aa, Plasmodium falciparum
KKGMLLNNAFLVIRKMGDGTFGRVLL

SEQ ID NO: 3386325 - protein, 25 aa, Plasmodium falciparum
KKGSNLFLNKFYSKGSFNSTMSKFN

SEQ ID NO: 3386326 - protein, 27 aa, Plasmodium falciparum
KKGTFVFTRLLFLSSTLDINEDRKSMI

SEQ ID NO: 3386327 - protein, 17 aa, Plasmodium falciparum
KKHELFKKKLNDIYNFL

SEQ ID NO: 3386328 - protein, 27 aa, Plasmodium falciparum
KKHRFQELLKFQNALKYGLNNNSLKNA

SEQ ID NO: 3386329 - protein, 17 aa, Plasmodium falciparum
KKHYRFCIKKLCDKIIP

SEQ ID NO: 3386330 - protein, 25 aa, Plasmodium falciparum
KKIDLFHMNSLNEDYSWVKNLRNYD

SEQ ID NO: 3386331 - protein, 17 aa, Plasmodium falciparum
KKIFILYATFELRQLNV

SEQ ID NO: 3386332 - protein, 29 aa, Plasmodium falciparum
KKIGTKKMKPFVPLEYRESFRNTFYKNEN

SEQ ID NO: 3386333 - protein, 21 aa, Plasmodium falciparum
KKIIHNINWTALINKDKYRND

SEQ ID NO: 3386334 - protein, 39 aa, Plasmodium falciparum
KKIILTCKSFCEYHYWITTIRALMFRSRKLKISRSILFS

SEQ ID NO: 3386335 - protein, 29 aa, Plasmodium falciparum
KKIINMLNQIPFIFSYKKKKIKNLVNTRE

SEQ ID NO: 3386336 - protein, 20 aa, Plasmodium falciparum
KKIKEIITPAGYKLPENLII

SEQ ID NO: 3386337 - protein, 19 aa, Plasmodium falciparum
KKIKTPFFNALKAYAERPI

SEQ ID NO: 3386338 - protein, 34 aa, Plasmodium falciparum
KKIKYSFYKPFSITYFRYFFSHFHFIKHITKDEI

SEQ ID NO: 3386339 - protein, 26 aa, Plasmodium falciparum
KKIKYYYHYDLLRKIGGANFKKGIQV

SEQ ID NO: 3386340 - protein, 24 aa, Plasmodium falciparum
KKILHDIIFLLHKYIDITKDVINN

SEQ ID NO: 3386341 - protein, 26 aa, Plasmodium falciparum
KKILHFQKNFYYNKLRFLELLCNQTN

SEQ ID NO: 3386342 - protein, 29 aa, Plasmodium falciparum
KKILKFEKILLRSYILNAYVFSNEKYKEN

SEQ ID NO: 3386343 - protein, 35 aa, Plasmodium falciparum
KKILNIFSEQNIRLVIVFLIDISFISSNTKLLSAY

SEQ ID NO: 3386344 - protein, 20 aa, Plasmodium falciparum
KKIMSRPFGVALLIGGVDKN

SEQ ID NO: 3386345 - protein, 27 aa, Plasmodium falciparum
KKINAPIDLVLLTKKLKRLPVVNFAAG

SEQ ID NO: 3386346 - protein, 23 aa, Plasmodium falciparum
KKINIAYPYFNNIILLLLEKLEI

SEQ ID NO: 3386347 - protein, 22 aa, Plasmodium falciparum
KKINKLYWAIKDTNPNASIRVI

SEQ ID NO: 3386348 - protein, 34 aa, Plasmodium falciparum
KKINKMIKNLIPLYRYIPLILQKLNTEYLVSVMN

SEQ ID NO: 3386349 - protein, 27 aa, Plasmodium falciparum
KKIQRILQYIPQSLKFLKSYISYRLCE

SEQ ID NO: 3386350 - protein, 23 aa, Plasmodium falciparum
KKISDYKCNLLYTSLDRIHKNVS

SEQ ID NO: 3386351 - protein, 29 aa, Plasmodium falciparum
KKISLFPPNIYVKDIIPLGIYNVKIVWSD

SEQ ID NO: 3386352 - protein, 26 aa, Plasmodium falciparum
KKISYDIFYHLVLTKQIQGTTNLLRS

SEQ ID NO: 3386353 - protein, 27 aa, Plasmodium falciparum
KKITSFSPVLLLNYVNKKYSFIKIIKK

SEQ ID NO: 3386354 - protein, 27 aa, Plasmodium falciparum
KKIVDIINDYKIVFKTLQKYAEKEKNI

SEQ ID NO: 3386355 - protein, 22 aa, Plasmodium falciparum
KKIYEYTYVFIPVNIENTHWSL

SEQ ID NO: 3386356 - protein, 20 aa, Plasmodium falciparum
KKIYIYGYDIYNVRNNIVKF

SEQ ID NO: 3386357 - protein, 31 aa, Plasmodium falciparum
KKKAPHYYKFNYKVCLYLNVFKEKYLTSELN

SEQ ID NO: 3386358 - protein, 20 aa, Plasmodium falciparum
KKKCFYVLLSSNDIHRYYPL

SEQ ID NO: 3386359 - protein, 18 aa, Plasmodium falciparum
KKKCLITNYIPLFHTHIL

SEQ ID NO: 3386360 - protein, 32 aa, Plasmodium falciparum
KKKDHYYVDKYHYINKYYPEKYSRKFNYNHSS

SEQ ID NO: 3386361 - protein, 30 aa, Plasmodium falciparum
KKKDLFNNQKFFIKNMYLNQNVLQSQLRNQ

SEQ ID NO: 3386362 - protein, 25 aa, Plasmodium falciparum
KKKDLLYEYENLKNRLKNITLVCNE

SEQ ID NO: 3386363 - protein, 23 aa, Plasmodium falciparum
KKKEIIYTHLFLPTRLREKINKS

SEQ ID NO: 3386364 - protein, 30 aa, Plasmodium falciparum
KKKEKTKFKKIIRYLIQNYKIKNINQANHH

SEQ ID NO: 3386365 - protein, 17 aa, Plasmodium falciparum
KKKERIIKNDKDLLKEL

SEQ ID NO: 3386366 - protein, 55 aa, Plasmodium falciparum
KKKFCRIKTFYCLKRKFLYNVDIKFLIKEKHFLKYLYLCTLKKKIQAHYNKQKRK

SEQ ID NO: 3386367 - protein, 22 aa, Plasmodium falciparum
KKKFQNIFYANCPEENYLNMKL

SEQ ID NO: 3386368 - protein, 37 aa, Plasmodium falciparum
KKKFTIKCDIWSAGVIMFFLFTKSLPFGGNTYDEVKQ

SEQ ID NO: 3386369 - protein, 17 aa, Plasmodium falciparum
KKKHIHIGLIGYPNVGK

SEQ ID NO: 3386370 - protein, 17 aa, Plasmodium falciparum
KKKIAPGMLFNFKIEFY

SEQ ID NO: 3386371 - protein, 23 aa, Plasmodium falciparum
KKKIEFMSIVDYYGGLKNNEYEF

SEQ ID NO: 3386372 - protein, 21 aa, Plasmodium falciparum
KKKIGFCSYCPRLDGFLNCFE

SEQ ID NO: 3386373 - protein, 28 aa, Plasmodium falciparum
KKKIKQSFAIKYLNLFSKSNILADVVVL

SEQ ID NO: 3386374 - protein, 17 aa, Plasmodium falciparum
KKKIKSKSYRKYLRIKE

SEQ ID NO: 3386375 - protein, 20 aa, Plasmodium falciparum
KKKILYTGKASCACKMKCYF

SEQ ID NO: 3386376 - protein, 21 aa, Plasmodium falciparum
KKKIQPMLFYQHNINSNIKQI

SEQ ID NO: 3386377 - protein, 25 aa, Plasmodium falciparum
KKKKAHLFACTYLNRKEPFPKRHID

SEQ ID NO: 3386378 - protein, 24 aa, Plasmodium falciparum
KKKKDILEKPVWKSLYDIEETVKD

SEQ ID NO: 3386379 - protein, 22 aa, Plasmodium falciparum
KKKKEMINLYSNKSNILENIKN

SEQ ID NO: 3386380 - protein, 23 aa, Plasmodium falciparum
KKKKESFLKWTPHKNIKRSYNKK

SEQ ID NO: 3386381 - protein, 24 aa, Plasmodium falciparum
KKKKEYFFNLYESNYNPFHSKDKV

SEQ ID NO: 3386382 - protein, 22 aa, Plasmodium falciparum
KKKKGNILKTYKVKLLQNNQHY

SEQ ID NO: 3386383 - protein, 31 aa, Plasmodium falciparum
KKKKHSSIYTLWIDYLISNNIDIQEFSKLRN

SEQ ID NO: 3386384 - protein, 23 aa, Plasmodium falciparum
KKKKICCVCLETKKLRDECIVKL

SEQ ID NO: 3386385 - protein, 23 aa, Plasmodium falciparum
KKKKIFNNNDYIFKMGPSETSKK

SEQ ID NO: 3386386 - protein, 23 aa, Plasmodium falciparum
KKKKIINYLCSYGNKKLNDPPDK

SEQ ID NO: 3386387 - protein, 23 aa, Plasmodium falciparum
KKKKIKLHLYSLSKNYIQIEDVQ

SEQ ID NO: 3386388 - protein, 19 aa, Plasmodium falciparum
KKKKILMYDLKITSEWKAY

SEQ ID NO: 3386389 - protein, 18 aa, Plasmodium falciparum
KKKKILRSFARLVNHSKK

SEQ ID NO: 3386390 - protein, 31 aa, Plasmodium falciparum
KKKKIQKDCFLFWLIMVKNKKEARNKIIKSF

SEQ ID NO: 3386391 - protein, 26 aa, Plasmodium falciparum
KKKKISLSKFLIKKHIIKLRKMEKLK

SEQ ID NO: 3386392 - protein, 45 aa, Plasmodium falciparum
KKKKKILKELDKCNSHFFFTYFHKGELIEYLHNQINMHIVEFDKI

SEQ ID NO: 3386393 - protein, 27 aa, Plasmodium falciparum
KKKKKKKFFFCSTFLYDNIKSNMFPNK

SEQ ID NO: 3386394 - protein, 25 aa, Plasmodium falciparum
KKKKKKLILPGHIKIKKLSACECVL

SEQ ID NO: 3386395 - protein, 29 aa, Plasmodium falciparum
KKKKKKYISYIPLHNYKILFLCLQEIFND

SEQ ID NO: 3386396 - protein, 27 aa, Plasmodium falciparum
KKKKKLIHHILFQLWMCEVDLGNIDDI

SEQ ID NO: 3386397 - protein, 32 aa, Plasmodium falciparum
KKKKKLPLFVTPKFIYDCILNYSISYPSKNKN

SEQ ID NO: 3386398 - protein, 34 aa, Plasmodium falciparum
KKKKKMNLLTRNNLKIKWILLNLNLKNDDEALIK

SEQ ID NO: 3386399 - protein, 23 aa, Plasmodium falciparum
KKKKKNFFNYHPINEANIYNING

SEQ ID NO: 3386400 - protein, 25 aa, Plasmodium falciparum
KKKKLLIHPIHLLNYVYNYNRLFCC

SEQ ID NO: 3386401 - protein, 46 aa, Plasmodium falciparum
KKKKMHFYKYSHSLYMKYNIKKMIYFIPKRIVLTTVAICIYGVHFL

SEQ ID NO: 3386402 - protein, 22 aa, Plasmodium falciparum
KKKKNIYIYFNKQGKHGHIKKE

SEQ ID NO: 3386403 - protein, 26 aa, Plasmodium falciparum
KKKKNSFFACSPLKDINLNRQKSLPP

SEQ ID NO: 3386404 - protein, 28 aa, Plasmodium falciparum
KKKKQQYFHILPFTDFYMNIEISYQIKC

SEQ ID NO: 3386405 - protein, 30 aa, Plasmodium falciparum
KKKKTLTNSLYLILYTKLRNLFGPNCGWAQ

SEQ ID NO: 3386406 - protein, 37 aa, Plasmodium falciparum
KKKLGKTMIFFCTKYHILFFSNILKHFKIHHSILYGN

SEQ ID NO: 3386407 - protein, 23 aa, Plasmodium falciparum
KKKLHLFLLSNKKRYYMSHREIE

SEQ ID NO: 3386408 - protein, 27 aa, Plasmodium falciparum
KKKLIKNGMLPCSFLLKKKNKVQPKNN

SEQ ID NO: 3386409 - protein, 32 aa, Plasmodium falciparum
KKKLKGLVVMPHEMYNLYKGKGKNLPKQWEYE

SEQ ID NO: 3386410 - protein, 21 aa, Plasmodium falciparum
KKKLYAYHTFNGSEQTRRKGY

SEQ ID NO: 3386411 - protein, 30 aa, Plasmodium falciparum
KKKMKISIRFKKPKTLIYARNPKCPRIVKS

SEQ ID NO: 3386412 - protein, 26 aa, Plasmodium falciparum
KKKNFENLLLEYTMSNNVLNTENNNA

SEQ ID NO: 3386413 - protein, 25 aa, Plasmodium falciparum
KKKNIFIDLINDPLEDIKVKHFALL

SEQ ID NO: 3386414 - protein, 35 aa, Plasmodium falciparum
KKKNINIDISKPRKLLFIIEMDGINIYIKDVLMNI

SEQ ID NO: 3386415 - protein, 19 aa, Plasmodium falciparum
KKKNMNDLFLGKHDNMLRT

SEQ ID NO: 3386416 - protein, 33 aa, Plasmodium falciparum
KKKNNMVHLLEIILKKLLLSPNYINGVVFFFKK

SEQ ID NO: 3386417 - protein, 24 aa, Plasmodium falciparum
KKKNRFYFFCKMNENKNVKNKKNI

SEQ ID NO: 3386418 - protein, 24 aa, Plasmodium falciparum
KKKNSFFITYSYWKYMSKKEKQND

SEQ ID NO: 3386419 - protein, 23 aa, Plasmodium falciparum
KKKNVLFFNPKIIKCGKYHSGAV

SEQ ID NO: 3386420 - protein, 18 aa, Plasmodium falciparum
KKKPIGSFPLNKITSIRT

SEQ ID NO: 3386421 - protein, 25 aa, Plasmodium falciparum
KKKQFFIKISLLLKKIAYEHNFFVF

SEQ ID NO: 3386422 - protein, 24 aa, Plasmodium falciparum
KKKRDFFFDVSFSFEGMKNNLIKR

SEQ ID NO: 3386423 - protein, 30 aa, Plasmodium falciparum
KKKRKENLMIYKKCFFFINAIDEYCNMCNI

SEQ ID NO: 3386424 - protein, 19 aa, Plasmodium falciparum
KKKRKEQYAYLIRNDDESS

SEQ ID NO: 3386425 - protein, 25 aa, Plasmodium falciparum
KKKSKWKSLFSSKKTKKKNLSDNFG

SEQ ID NO: 3386426 - protein, 24 aa, Plasmodium falciparum
KKKSLENKILLSKKLKEIKLQFKD

SEQ ID NO: 3386427 - protein, 31 aa, Plasmodium falciparum
KKKSTTFLHTKLPSKLLVLCENCKLPCHANY

SEQ ID NO: 3386428 - protein, 18 aa, Plasmodium falciparum
KKKTILTDILLSSTFVTF

SEQ ID NO: 3386429 - protein, 30 aa, Plasmodium falciparum
KKKTLLLSGWSFTFKCETQHLTNVCFQLIN

SEQ ID NO: 3386430 - protein, 24 aa, Plasmodium falciparum
KKKTYIVHGMEIPEQIFNMYNTSK

SEQ ID NO: 3386431 - protein, 17 aa, Plasmodium falciparum
KKKWKVHYILNKTKKKI

SEQ ID NO: 3386432 - protein, 19 aa, Plasmodium falciparum
KKKYFYHINKNINSLWKVY

SEQ ID NO: 3386433 - protein, 19 aa, Plasmodium falciparum
KKKYIFCNKNRLISNVGNK

SEQ ID NO: 3386434 - protein, 23 aa, Plasmodium falciparum
KKKYIRIFSYGYSKFKFIGKHQI

SEQ ID NO: 3386435 - protein, 26 aa, Plasmodium falciparum
KKKYKNFYIHIVNLNTLFGIYFNETE

SEQ ID NO: 3386436 - protein, 26 aa, Plasmodium falciparum
KKLCLVLDLDNTLLHASFSLLSVNVN

SEQ ID NO: 3386437 - protein, 21 aa, Plasmodium falciparum
KKLEDFVKHKKNIKENVLGKE

SEQ ID NO: 3386438 - protein, 20 aa, Plasmodium falciparum
KKLFCIILQNHTKYEHIFVI

SEQ ID NO: 3386439 - protein, 20 aa, Plasmodium falciparum
KKLFFELYMKEKDSEINIGV

SEQ ID NO: 3386440 - protein, 25 aa, Plasmodium falciparum
KKLGFQCIYCRDRQLFKKKSSVLYH

SEQ ID NO: 3386441 - protein, 30 aa, Plasmodium falciparum
KKLIHKYLKRIKIFWSFCFFKNLEYCLRQA

SEQ ID NO: 3386442 - protein, 33 aa, Plasmodium falciparum
KKLITSGLLHYSTYKVIKYFLNVLKGEPYHLDI

SEQ ID NO: 3386443 - protein, 36 aa, Plasmodium falciparum
KKLKEKEKIIWFNELKTYLLKNTLALLAAEKIVSYI

SEQ ID NO: 3386444 - protein, 34 aa, Plasmodium falciparum
KKLKKLFKEIKNNKLCKYILAKIKEIKYNKTYME

SEQ ID NO: 3386445 - protein, 26 aa, Plasmodium falciparum
KKLKKWSCIYKINKIVRKGAHGVVFS

SEQ ID NO: 3386446 - protein, 26 aa, Plasmodium falciparum
KKLKSYMFNGGRYAFAAKLKEEIKHF

SEQ ID NO: 3386447 - protein, 26 aa, Plasmodium falciparum
KKLKYAFDDIYLNNIFFSFFTSFKLM

SEQ ID NO: 3386448 - protein, 25 aa, Plasmodium falciparum
KKLKYKTFWTYLKQQKDDKKEMLNY

SEQ ID NO: 3386449 - protein, 19 aa, Plasmodium falciparum
KKLLCVLAMGEWIDYSHPI

SEQ ID NO: 3386450 - protein, 20 aa, Plasmodium falciparum
KKLMKLILNVKKEDSDAVQK

SEQ ID NO: 3386451 - protein, 24 aa, Plasmodium falciparum
KKLMNIRMMYPFTLKCNKCKTFTY

SEQ ID NO: 3386452 - protein, 24 aa, Plasmodium falciparum
KKLNCFDFILGNEILYRKENYYHI

SEQ ID NO: 3386453 - protein, 19 aa, Plasmodium falciparum
KKLNKSNFIFLIKQIEKCI

SEQ ID NO: 3386454 - protein, 23 aa, Plasmodium falciparum
KKLNQYIVTFISSSSRDEFVNKI

SEQ ID NO: 3386455 - protein, 24 aa, Plasmodium falciparum
KKLQKYMNELWGFSSSENEEEKKY

SEQ ID NO: 3386456 - protein, 18 aa, Plasmodium falciparum
KKLQLLENKIYSYITTLT

SEQ ID NO: 3386457 - protein, 22 aa, Plasmodium falciparum
KKLRKRYIILTKNFICSFKSEY

SEQ ID NO: 3386458 - protein, 22 aa, Plasmodium falciparum
KKLTVYIPCPVLLNFVCTEQKA

SEQ ID NO: 3386459 - protein, 35 aa, Plasmodium falciparum
KKLVKKCIKKYKKLLKLIKKVILLSVENGNQVNEE

SEQ ID NO: 3386460 - protein, 28 aa, Plasmodium falciparum
KKMANLEIFRYFPTPVKYRNYEAKILYS

SEQ ID NO: 3386461 - protein, 30 aa, Plasmodium falciparum
KKMCFKKKYVCLECNKIYLHLNGYNKHINK

SEQ ID NO: 3386462 - protein, 28 aa, Plasmodium falciparum
KKMEDFTELLFFPYTIKGMDISFSGYDF

SEQ ID NO: 3386463 - protein, 31 aa, Plasmodium falciparum
KKMFHNFLDAFYHFISIRIYNLFSVSNVFHE

SEQ ID NO: 3386464 - protein, 26 aa, Plasmodium falciparum
KKMGEIFFEYFDTLNLNLSVSGLMSL

SEQ ID NO: 3386465 - protein, 24 aa, Plasmodium falciparum
KKMIFFRQDILNDLIWSSSINATD

SEQ ID NO: 3386466 - protein, 22 aa, Plasmodium falciparum
KKMNFKVLFLYKQLIPEKKEDK

SEQ ID NO: 3386467 - protein, 19 aa, Plasmodium falciparum
KKMNIIYEKTIYDDNLNKK

SEQ ID NO: 3386468 - protein, 19 aa, Plasmodium falciparum
KKMNLLKKVLVDRDKKKAN

SEQ ID NO: 3386469 - protein, 40 aa, Plasmodium falciparum
KKMNSFIRDNFFLPQPIYPPYHLFDFFSSILRIGQTNLFI

SEQ ID NO: 3386470 - protein, 21 aa, Plasmodium falciparum
KKMNTFKLNIPSSIINKFNKS

SEQ ID NO: 3386471 - protein, 28 aa, Plasmodium falciparum
KKNCKIIKRLLWGELFEEKKKRIRKVSP

SEQ ID NO: 3386472 - protein, 25 aa, Plasmodium falciparum
KKNDDHTFLLSNKKIYDTYKERKSD

SEQ ID NO: 3386473 - protein, 24 aa, Plasmodium falciparum
KKNDIYFQYIIIFDINSIDHPIVC

SEQ ID NO: 3386474 - protein, 27 aa, Plasmodium falciparum
KKNDSEYLYFQNMIRNITKYNNEENDM

SEQ ID NO: 3386475 - protein, 26 aa, Plasmodium falciparum
KKNDTLCIICLQNEKKYTFTCCYEYY

SEQ ID NO: 3386476 - protein, 18 aa, Plasmodium falciparum
KKNEGSTIFFSLNGQIKK

SEQ ID NO: 3386477 - protein, 20 aa, Plasmodium falciparum
KKNEQFIPMTLKNLINVIQQ

SEQ ID NO: 3386478 - protein, 26 aa, Plasmodium falciparum
KKNFALIKNFIYPFKNKNNLYNNYKI

SEQ ID NO: 3386479 - protein, 20 aa, Plasmodium falciparum
KKNHIYCRCLKISIISSQHN

SEQ ID NO: 3386480 - protein, 20 aa, Plasmodium falciparum
KKNIDMVYKIKEYEIQIKEK

SEQ ID NO: 3386481 - protein, 23 aa, Plasmodium falciparum
KKNIEPLIIIYKPNYDPFEYIYK

SEQ ID NO: 3386482 - protein, 27 aa, Plasmodium falciparum
KKNIIIYLEKKRENWWPCVIKGDTEID

SEQ ID NO: 3386483 - protein, 20 aa, Plasmodium falciparum
KKNILFLHPYNYCKLDDNFD

SEQ ID NO: 3386484 - protein, 31 aa, Plasmodium falciparum
KKNIQIQKLLKQYIILKGYYKNVCKKYRQEN

SEQ ID NO: 3386485 - protein, 25 aa, Plasmodium falciparum
KKNKIVYLLFNFKIKKSLSYNIRLD

SEQ ID NO: 3386486 - protein, 27 aa, Plasmodium falciparum
KKNKKIIDTFYRYLNKEEKKYSSDKYS

SEQ ID NO: 3386487 - protein, 23 aa, Plasmodium falciparum
KKNKKVIFLHRRGSHLPFEYHLK

SEQ ID NO: 3386488 - protein, 18 aa, Plasmodium falciparum
KKNKKYPFSNKKINFKYF

SEQ ID NO: 3386489 - protein, 28 aa, Plasmodium falciparum
KKNKNHIISPHKITLKYKTMPIPFDHNI

SEQ ID NO: 3386490 - protein, 31 aa, Plasmodium falciparum
KKNKNTTSLFKRFKIFGKTKNAPKGEVSDLK

SEQ ID NO: 3386491 - protein, 28 aa, Plasmodium falciparum
KKNLFSLVVLDFLWKIYDITIINRDDEQ

SEQ ID NO: 3386492 - protein, 33 aa, Plasmodium falciparum
KKNLLYKLIGNIDSYFLLYTKFKVDAEAYKDLK

SEQ ID NO: 3386493 - protein, 26 aa, Plasmodium falciparum
KKNLRDVIFKIFAVINSKRFNGDMIG

SEQ ID NO: 3386494 - protein, 23 aa, Plasmodium falciparum
KKNLTNILPFEKIVEQCDINNVI

SEQ ID NO: 3386495 - protein, 22 aa, Plasmodium falciparum
KKNLTYINDLKKIFFKENAVKN

SEQ ID NO: 3386496 - protein, 39 aa, Plasmodium falciparum
KKNNNKILIDNILHNLIILFYEFYYYNQMDNFKIDLDFY

SEQ ID NO: 3386497 - protein, 43 aa, Plasmodium falciparum
KKNNTICSNCLYAYKIQICKRVEMFNFFGGKNDGLDKDALKEG

SEQ ID NO: 3386498 - protein, 18 aa, Plasmodium falciparum
KKNNYSIMAILGSQIKNL

SEQ ID NO: 3386499 - protein, 26 aa, Plasmodium falciparum
KKNQNNFYFIFYDGSNIHISPLNQIK

SEQ ID NO: 3386500 - protein, 27 aa, Plasmodium falciparum
KKNTKNDPLLLYLQTNFMKKEEENLLT

SEQ ID NO: 3386501 - protein, 25 aa, Plasmodium falciparum
KKNTNIYLFNLYFDENMKTLLYIIP

SEQ ID NO: 3386502 - protein, 24 aa, Plasmodium falciparum
KKNTYIKELYKRSGDYDNFSIHTD

SEQ ID NO: 3386503 - protein, 25 aa, Plasmodium falciparum
KKNVCIIIPDIYRPIGKYKIKTYVK

SEQ ID NO: 3386504 - protein, 25 aa, Plasmodium falciparum
KKNVNCNYELINKNLLKVAANNINN

SEQ ID NO: 3386505 - protein, 24 aa, Plasmodium falciparum
KKNVVVLHDQLDKLQLLFDNNQKK

SEQ ID NO: 3386506 - protein, 20 aa, Plasmodium falciparum
KKNYFVARSIFNIRNVNGKF

SEQ ID NO: 3386507 - protein, 17 aa, Plasmodium falciparum
KKNYMYNINNMNYMPNV

SEQ ID NO: 3386508 - protein, 25 aa, Plasmodium falciparum
KKPNLMTYGYFYKKFIMRSKKKNWL

SEQ ID NO: 3386509 - protein, 22 aa, Plasmodium falciparum
KKQCFINSSFNASLNFDKLKKG

SEQ ID NO: 3386510 - protein, 19 aa, Plasmodium falciparum
KKQEALEKKLRLIQSEQTD

SEQ ID NO: 3386511 - protein, 26 aa, Plasmodium falciparum
KKQENCSYIILAGLYTVSNDNKKECR

SEQ ID NO: 3386512 - protein, 24 aa, Plasmodium falciparum
KKQFKIKFIPLKNKSELKFYISNN

SEQ ID NO: 3386513 - protein, 22 aa, Plasmodium falciparum
KKQIDYIIHLKYYKNEYDNVTN

SEQ ID NO: 3386514 - protein, 42 aa, Plasmodium falciparum
KKQKIIKKKILISLKKRGAIFILTPIILLNKYYINLENTYME

SEQ ID NO: 3386515 - protein, 30 aa, Plasmodium falciparum
KKQKKMIWNSLNVLPIDILLKNGHDEINKE

SEQ ID NO: 3386516 - protein, 25 aa, Plasmodium falciparum
KKQRGLFSFVPLLAKIAEHLKTHHI

SEQ ID NO: 3386517 - protein, 27 aa, Plasmodium falciparum
KKQRKKKIWKTPFGNKSIYKNARERVQ

SEQ ID NO: 3386518 - protein, 23 aa, Plasmodium falciparum
KKRAERFGLLQDSEKLKARALRF

SEQ ID NO: 3386519 - protein, 23 aa, Plasmodium falciparum
KKRDMEMYILLEENKKQKEKAAK

SEQ ID NO: 3386520 - protein, 29 aa, Plasmodium falciparum
KKRESFFKKINILQKYKNYKIRKAASTFH

SEQ ID NO: 3386521 - protein, 24 aa, Plasmodium falciparum
KKRGNIFESLNSFIYNFKNNNNIN

SEQ ID NO: 3386522 - protein, 22 aa, Plasmodium falciparum
KKRKFKIIHLLYNVWKEYKHKK

SEQ ID NO: 3386523 - protein, 19 aa, Plasmodium falciparum
KKRKFTAFSIFAREKRKEY

SEQ ID NO: 3386524 - protein, 18 aa, Plasmodium falciparum
KKRKIKRPFPNDKKKELS

SEQ ID NO: 3386525 - protein, 24 aa, Plasmodium falciparum
KKRKKKIIINVRKKSQRASLSTSQ

SEQ ID NO: 3386526 - protein, 22 aa, Plasmodium falciparum
KKRKRIDFIIKYFINAAKEINN

SEQ ID NO: 3386527 - protein, 43 aa, Plasmodium falciparum
KKRKRNITYPYFMFYQINNFLINPNPFHNSFFLNEMNYCSIMH

SEQ ID NO: 3386528 - protein, 29 aa, Plasmodium falciparum
KKRKSYPSISHSPLSSIPSLYTYSNSNSE

SEQ ID NO: 3386529 - protein, 20 aa, Plasmodium falciparum
KKRLPKGSKRYVPTQEEVER

SEQ ID NO: 3386530 - protein, 38 aa, Plasmodium falciparum
KKRRRSSYYIYCRTKKYSFPRIVNVFSSVVRMCQKKEE

SEQ ID NO: 3386531 - protein, 22 aa, Plasmodium falciparum
KKRSYLSNIFFKLSYDTIENLM

SEQ ID NO: 3386532 - protein, 18 aa, Plasmodium falciparum
KKSFSLYDIKTYEYKKNI

SEQ ID NO: 3386533 - protein, 24 aa, Plasmodium falciparum
KKSHFFYTLFINQGIHFFNNITIY

SEQ ID NO: 3386534 - protein, 24 aa, Plasmodium falciparum
KKSHIHIRYKYDVFNYCLKNIKRN

SEQ ID NO: 3386535 - protein, 34 aa, Plasmodium falciparum
KKSIFDNIKIPFPLLSRFDLVFLLADNISEEKDY

SEQ ID NO: 3386536 - protein, 23 aa, Plasmodium falciparum
KKSINYKAYYKYSLYYDIQMNIS

SEQ ID NO: 3386537 - protein, 24 aa, Plasmodium falciparum
KKSKRLRWFRLKRKKKKDYVNEES

SEQ ID NO: 3386538 - protein, 25 aa, Plasmodium falciparum
KKSKYMEALINSAKRRELEKEFLIQ

SEQ ID NO: 3386539 - protein, 24 aa, Plasmodium falciparum
KKSLDFIQSYWYWKIRSESNLLNY

SEQ ID NO: 3386540 - protein, 21 aa, Plasmodium falciparum
KKSLENFFNIVLKNLYSSINF

SEQ ID NO: 3386541 - protein, 18 aa, Plasmodium falciparum
KKSLPYEKALSSTISQIN

SEQ ID NO: 3386542 - protein, 33 aa, Plasmodium falciparum
KKSPYTRFTEIFTDKLKNFTLGNRKSFRSSTVH

SEQ ID NO: 3386543 - protein, 32 aa, Plasmodium falciparum
KKSQVLFSVQPYYIYLYTKKEALLFTRFYKSM

SEQ ID NO: 3386544 - protein, 24 aa, Plasmodium falciparum
KKSRKYINLMKKVQIYHLNMIDNI

SEQ ID NO: 3386545 - protein, 23 aa, Plasmodium falciparum
KKTDMLNLIQELLSYCECLKRNR

SEQ ID NO: 3386546 - protein, 26 aa, Plasmodium falciparum
KKTDMYNWYIIQINKDVYIDSGKKGS

SEQ ID NO: 3386547 - protein, 23 aa, Plasmodium falciparum
KKTDVYWRLAFARRNINVLENVT

SEQ ID NO: 3386548 - protein, 21 aa, Plasmodium falciparum
KKTEYLLEQIKIPSWDRNNIP

SEQ ID NO: 3386549 - protein, 23 aa, Plasmodium falciparum
KKTFHRILAVYFGHERWDLVMNM

SEQ ID NO: 3386550 - protein, 36 aa, Plasmodium falciparum
KKTIDSILNMLTPWEQKILALLYEQQKMRQDVQKIK

SEQ ID NO: 3386551 - protein, 23 aa, Plasmodium falciparum
KKTIELRLPIPITKYMKKMEISK

SEQ ID NO: 3386552 - protein, 37 aa, Plasmodium falciparum
KKTKKILIDPHYHCPLCVNMYFYHYNMLTEHCSNFHK

SEQ ID NO: 3386553 - protein, 30 aa, Plasmodium falciparum
KKTKKKTFLVNQAVFFTPKKSVLNSSNEKK

SEQ ID NO: 3386554 - protein, 26 aa, Plasmodium falciparum
KKTNIEYILPLYLINNGDNIGSSAVI

SEQ ID NO: 3386555 - protein, 20 aa, Plasmodium falciparum
KKTNIFKKYYLFHNKKNNQE

SEQ ID NO: 3386556 - protein, 27 aa, Plasmodium falciparum
KKTPEAYLLNNYYLMFQQKLENQQSYT

SEQ ID NO: 3386557 - protein, 33 aa, Plasmodium falciparum
KKTTPCCTFGYYYFETFLFRNNKMIPKLKKKDC

SEQ ID NO: 3386558 - protein, 35 aa, Plasmodium falciparum
KKTVEDLFYIYKSFGFIYSIIKKANLLLSKENFDT

SEQ ID NO: 3386559 - protein, 20 aa, Plasmodium falciparum
KKVCKLCWKFLTVAIVLLDT

SEQ ID NO: 3386560 - protein, 24 aa, Plasmodium falciparum
KKVCLYKPIILLKSGKTAKAAEAA

SEQ ID NO: 3386561 - protein, 27 aa, Plasmodium falciparum
KKVEKMKWTILSERKIDKLVDIMKGEE

SEQ ID NO: 3386562 - protein, 19 aa, Plasmodium falciparum
KKVFLLIKKMKHIKKKLLK

SEQ ID NO: 3386563 - protein, 21 aa, Plasmodium falciparum
KKVLKKFLKLYRSQNKNFLPK

SEQ ID NO: 3386564 - protein, 28 aa, Plasmodium falciparum
KKVNKILKLIHILFGRKYHCFESLYNFE

SEQ ID NO: 3386565 - protein, 29 aa, Plasmodium falciparum
KKVNKNITYIRLHLEKFALKNKETIDKIE

SEQ ID NO: 3386566 - protein, 22 aa, Plasmodium falciparum
KKVPQIYWMLNHINNMFNEIKN

SEQ ID NO: 3386567 - protein, 25 aa, Plasmodium falciparum
KKVQHIFFQFVLKTLQRNNKNRLTH

SEQ ID NO: 3386568 - protein, 22 aa, Plasmodium falciparum
KKVSWAFGLIDKNFYFTDFIDE

SEQ ID NO: 3386569 - protein, 23 aa, Plasmodium falciparum
KKVWKKLIEYFLNMTKSNMNNNL

SEQ ID NO: 3386570 - protein, 34 aa, Plasmodium falciparum
KKVYVHLESPLDILVCAGLISSKKLIEAQAILKE

SEQ ID NO: 3386571 - protein, 20 aa, Plasmodium falciparum
KKWHSNFNYEEIVFPSVTLE

SEQ ID NO: 3386572 - protein, 26 aa, Plasmodium falciparum
KKYEDAYYILFSFPSTLNNESVKRIL

SEQ ID NO: 3386573 - protein, 27 aa, Plasmodium falciparum
KKYEEKSFILFRFFNNNKAYETTTKII

SEQ ID NO: 3386574 - protein, 21 aa, Plasmodium falciparum
KKYIHQIAYHESTKPDYINMN

SEQ ID NO: 3386575 - protein, 24 aa, Plasmodium falciparum
KKYIRKSDFLLALDTYPFGMGIVV

SEQ ID NO: 3386576 - protein, 19 aa, Plasmodium falciparum
KKYIYLYNKYDNATLDLNV

SEQ ID NO: 3386577 - protein, 17 aa, Plasmodium falciparum
KKYIYNCINYAYDLGSK

SEQ ID NO: 3386578 - protein, 32 aa, Plasmodium falciparum
KKYKNIPIIKRYNSMYLPYYTTNTDILYCNKQ

SEQ ID NO: 3386579 - protein, 30 aa, Plasmodium falciparum
KKYNKKILRNILNNVWLKTDMFIKESIYYG

SEQ ID NO: 3386580 - protein, 25 aa, Plasmodium falciparum
KKYQKLDIRTLNKNVQKNKEICTNC

SEQ ID NO: 3386581 - protein, 20 aa, Plasmodium falciparum
KKYSTILIKNYFQLHGPDSV

SEQ ID NO: 3386582 - protein, 25 aa, Plasmodium falciparum
KKYTYGLSHLWPVRDPRPVLEKVTG

SEQ ID NO: 3386583 - protein, 18 aa, Plasmodium falciparum
KKYWNSILSAQKYHFCNK

SEQ ID NO: 3386584 - protein, 19 aa, Plasmodium falciparum
KKYYLLKNETSPLERHNKD

SEQ ID NO: 3386585 - protein, 28 aa, Plasmodium falciparum
KLAFEEPFQLLFLMGFTIYATEGTYDFY

SEQ ID NO: 3386586 - protein, 17 aa, Plasmodium falciparum
KLAFLKTDEQFLKVSKF

SEQ ID NO: 3386587 - protein, 21 aa, Plasmodium falciparum
KLAIILATHDFFLVSKLCNRI

SEQ ID NO: 3386588 - protein, 25 aa, Plasmodium falciparum
KLASDNMLYFYQLNNFWADIGKPLD

SEQ ID NO: 3386589 - protein, 17 aa, Plasmodium falciparum
KLAYNLKLIGVSVAGII

SEQ ID NO: 3386590 - protein, 28 aa, Plasmodium falciparum
KLCAKGKWILKILQLYETSLVRHGFMLV

SEQ ID NO: 3386591 - protein, 19 aa, Plasmodium falciparum
KLCHALLHNYFDDIRNLKV

SEQ ID NO: 3386592 - protein, 31 aa, Plasmodium falciparum
KLCSESEAFFYAWLYLSCLKKINISRTKNNY

SEQ ID NO: 3386593 - protein, 29 aa, Plasmodium falciparum
KLCSVNKKKKYLWFYKNGNMNKRSILNFI

SEQ ID NO: 3386594 - protein, 19 aa, Plasmodium falciparum
KLCVMWELDLSYNYFKEIS

SEQ ID NO: 3386595 - protein, 22 aa, Plasmodium falciparum
KLDCLSKSFSKIRKINLCNSAY

SEQ ID NO: 3386596 - protein, 26 aa, Plasmodium falciparum
KLDERKYIFPFYQVYTYLKNQQHIFE

SEQ ID NO: 3386597 - protein, 21 aa, Plasmodium falciparum
KLDIKMKLFSICSNLMRKDNS

SEQ ID NO: 3386598 - protein, 25 aa, Plasmodium falciparum
KLDKVFDLVVLPKSEKERNLIDKII

SEQ ID NO: 3386599 - protein, 24 aa, Plasmodium falciparum
KLDSYNLKDFFIDNNNYNMKEEKY

SEQ ID NO: 3386600 - protein, 29 aa, Plasmodium falciparum
KLDVPSLVEICKQQLIVILKDMCSDCSTT

SEQ ID NO: 3386601 - protein, 28 aa, Plasmodium falciparum
KLDYLSIIFNFYSWYKRHFKGTLLINEN

SEQ ID NO: 3386602 - protein, 25 aa, Plasmodium falciparum
KLDYVQFVLYVNSSGQIFCMPLNLN

SEQ ID NO: 3386603 - protein, 24 aa, Plasmodium falciparum
KLEADLEWKIFYISAVNNEGESNQ

SEQ ID NO: 3386604 - protein, 39 aa, Plasmodium falciparum
KLECIEKILFFYFNVYKQRIFFLKLKSSTLIIQKNYRTY

SEQ ID NO: 3386605 - protein, 21 aa, Plasmodium falciparum
KLEEILYSIEKVHIKDKIILD

SEQ ID NO: 3386606 - protein, 28 aa, Plasmodium falciparum
KLEFEKVYCPYLLLNKKRYAGLLYTNPN

SEQ ID NO: 3386607 - protein, 20 aa, Plasmodium falciparum
KLEGKLYDYVVLTKNLKEKI

SEQ ID NO: 3386608 - protein, 33 aa, Plasmodium falciparum
KLEIIIKFKKYNTYFSAILKLKTFNTPMKNYIY

SEQ ID NO: 3386609 - protein, 18 aa, Plasmodium falciparum
KLEINGCIKIKRKGAHEE

SEQ ID NO: 3386610 - protein, 25 aa, Plasmodium falciparum
KLEKEKMNILLKDKLNELEKNVFFM

SEQ ID NO: 3386611 - protein, 19 aa, Plasmodium falciparum
KLEKLMEVYCNRLGQSMEA

SEQ ID NO: 3386612 - protein, 20 aa, Plasmodium falciparum
KLELFLPEQYPMEPPKVRFL

SEQ ID NO: 3386613 - protein, 20 aa, Plasmodium falciparum
KLEMLKRIIINWVNKKHNEF

SEQ ID NO: 3386614 - protein, 24 aa, Plasmodium falciparum
KLENALWIAEIIHDSFIVQGTHTV

SEQ ID NO: 3386615 - protein, 21 aa, Plasmodium falciparum
KLEQFEYIIYRIECKLSNMIN

SEQ ID NO: 3386616 - protein, 20 aa, Plasmodium falciparum
KLESFKCLFFTKDNLIDIEK

SEQ ID NO: 3386617 - protein, 18 aa, Plasmodium falciparum
KLESNKSLIIFPVNIHEY

SEQ ID NO: 3386618 - protein, 24 aa, Plasmodium falciparum
KLETLYKLLGFEIILEDDKIVIEF

SEQ ID NO: 3386619 - protein, 18 aa, Plasmodium falciparum
KLEWLCLDLDLVECLMAR

SEQ ID NO: 3386620 - protein, 17 aa, Plasmodium falciparum
KLEYINGAVKLLNKEMT

SEQ ID NO: 3386621 - protein, 22 aa, Plasmodium falciparum
KLFDYHFLSVKILGQSFLMHQI

SEQ ID NO: 3386622 - protein, 21 aa, Plasmodium falciparum
KLFEYDFIFNYAFNKESINNN

SEQ ID NO: 3386623 - protein, 17 aa, Plasmodium falciparum
KLFFKPHMEQFYNFSLL

SEQ ID NO: 3386624 - protein, 17 aa, Plasmodium falciparum
KLFNWIIKNLESPRYYS

SEQ ID NO: 3386625 - protein, 29 aa, Plasmodium falciparum
KLFSLIDTWFTYSKNMCLNFFDIIHKITK

SEQ ID NO: 3386626 - protein, 29 aa, Plasmodium falciparum
KLFSQENIFLFGFYIKYRNILKLFSSPRC

SEQ ID NO: 3386627 - protein, 23 aa, Plasmodium falciparum
KLGKESDGWIIQKKAKRKKKKKK

SEQ ID NO: 3386628 - protein, 18 aa, Plasmodium falciparum
KLGLFGRKMFIYNRIKGI

SEQ ID NO: 3386629 - protein, 18 aa, Plasmodium falciparum
KLGRKVIIVICYQCNNRN

SEQ ID NO: 3386630 - protein, 23 aa, Plasmodium falciparum
KLHIIRIMLEAIYFIAHYLDIFI

SEQ ID NO: 3386631 - protein, 23 aa, Plasmodium falciparum
KLHKQLYRDFKILMNIDISQIQN

SEQ ID NO: 3386632 - protein, 26 aa, Plasmodium falciparum
KLHLDTLFFIFYYQPGTYQQHLAAKE

SEQ ID NO: 3386633 - protein, 18 aa, Plasmodium falciparum
KLHNKNDVMFHMYADNNQ

SEQ ID NO: 3386634 - protein, 21 aa, Plasmodium falciparum
KLHNLIVLKIIQVIHSLDNIP

SEQ ID NO: 3386635 - protein, 20 aa, Plasmodium falciparum
KLHTNFMVYIQKYYDFSKTY

SEQ ID NO: 3386636 - protein, 27 aa, Plasmodium falciparum
KLHVRILQNSLIFHTLLQGSKKIINML

SEQ ID NO: 3386637 - protein, 24 aa, Plasmodium falciparum
KLIEKIVWPEIYNKKIDVNKIKFP

SEQ ID NO: 3386638 - protein, 38 aa, Plasmodium falciparum
KLIESINIYQRAVNAALYLFHYILHMLEITSQKNNNML

SEQ ID NO: 3386639 - protein, 21 aa, Plasmodium falciparum
KLIHFYEAYDSLPLLIEQLKS

SEQ ID NO: 3386640 - protein, 21 aa, Plasmodium falciparum
KLIINEILKKDKDILKQIILD

SEQ ID NO: 3386641 - protein, 19 aa, Plasmodium falciparum
KLIIYFPLEYIQHNILYIL

SEQ ID NO: 3386642 - protein, 20 aa, Plasmodium falciparum
KLIKFVGYPTKLSIKAFMLT

SEQ ID NO: 3386643 - protein, 19 aa, Plasmodium falciparum
KLIKIFIDGDYYYNKFLEK

SEQ ID NO: 3386644 - protein, 18 aa, Plasmodium falciparum
KLIKIKKEYINTALAVHL

SEQ ID NO: 3386645 - protein, 18 aa, Plasmodium falciparum
KLILKLYMHEKENIYKEI

SEQ ID NO: 3386646 - protein, 21 aa, Plasmodium falciparum
KLILYNNPDLILFVGEALVGN

SEQ ID NO: 3386647 - protein, 18 aa, Plasmodium falciparum
KLINIFVNNICDIIEYLC

SEQ ID NO: 3386648 - protein, 17 aa, Plasmodium falciparum
KLINMQEYKTKKLLDER

SEQ ID NO: 3386649 - protein, 20 aa, Plasmodium falciparum
KLINNFFLTINKLSNHGFSS

SEQ ID NO: 3386650 - protein, 34 aa, Plasmodium falciparum
KLINTIYREFNSRLYPIIICNILSDTKNIDINVT

SEQ ID NO: 3386651 - protein, 17 aa, Plasmodium falciparum
KLIPYLENVFIKNIFCC

SEQ ID NO: 3386652 - protein, 25 aa, Plasmodium falciparum
KLIQINEKFGILKLFKPDIYNCNNE

SEQ ID NO: 3386653 - protein, 33 aa, Plasmodium falciparum
KLIRETSLWHINKFFDIFNFKKNFALIKNFIYP

SEQ ID NO: 3386654 - protein, 35 aa, Plasmodium falciparum
KLISDFIEYYIALLKFVLFKLYKLDNMLYPPKQDN

SEQ ID NO: 3386655 - protein, 18 aa, Plasmodium falciparum
KLISKEIILLKNLDKYKP

SEQ ID NO: 3386656 - protein, 27 aa, Plasmodium falciparum
KLISKIFIDLEIPYISNVVYCYCNKFD

SEQ ID NO: 3386657 - protein, 25 aa, Plasmodium falciparum
KLIYYDVVSLIKILSKLNKLFKKIY

SEQ ID NO: 3386658 - protein, 27 aa, Plasmodium falciparum
KLKDETYLNIPIWKFYGKCQECKNEII

SEQ ID NO: 3386659 - protein, 37 aa, Plasmodium falciparum
KLKDLHYILNIKIYPIRTLVLYILYNSFFKDYNNEFI

SEQ ID NO: 3386660 - protein, 26 aa, Plasmodium falciparum
KLKEPTNSILLNKYNKYDLCEENKMG

SEQ ID NO: 3386661 - protein, 21 aa, Plasmodium falciparum
KLKESIMMMEKYKIIMNNNIQ

SEQ ID NO: 3386662 - protein, 20 aa, Plasmodium falciparum
KLKKFLHFYAELHKKCNYEE

SEQ ID NO: 3386663 - protein, 18 aa, Plasmodium falciparum
KLKKKKLLFLSKDITHHI

SEQ ID NO: 3386664 - protein, 18 aa, Plasmodium falciparum
KLKKKMHLNFIDYIKKEE

SEQ ID NO: 3386665 - protein, 26 aa, Plasmodium falciparum
KLKKKTILIYIPYKIYTTYVRKIQRK

SEQ ID NO: 3386666 - protein, 27 aa, Plasmodium falciparum
KLKNFENILCLYPYFNDYQLRKLSELI

SEQ ID NO: 3386667 - protein, 18 aa, Plasmodium falciparum
KLKNFFDISIRSSVLYHL

SEQ ID NO: 3386668 - protein, 25 aa, Plasmodium falciparum
KLKNFRLDLIDGFLYDKQSLYEREM

SEQ ID NO: 3386669 - protein, 23 aa, Plasmodium falciparum
KLKNIEKKYIYLKDICDLLNKSL

SEQ ID NO: 3386670 - protein, 18 aa, Plasmodium falciparum
KLKNPFSLLTTLGTKNKE

SEQ ID NO: 3386671 - protein, 23 aa, Plasmodium falciparum
KLKNYFIPLYTEKFSKKNVNSNS

SEQ ID NO: 3386672 - protein, 24 aa, Plasmodium falciparum
KLKSYPFFLNHIIHFNKLTKNNCF

SEQ ID NO: 3386673 - protein, 27 aa, Plasmodium falciparum
KLKYEKQVFQKAYGLSLDDDICYDNFL

SEQ ID NO: 3386674 - protein, 24 aa, Plasmodium falciparum
KLKYTVIEEGSFGVVYKGWYKGMH

SEQ ID NO: 3386675 - protein, 20 aa, Plasmodium falciparum
KLLEQTFDICITTFDLVIKE

SEQ ID NO: 3386676 - protein, 27 aa, Plasmodium falciparum
KLLESIPLVILLRNRLKYALTFDEVKM

SEQ ID NO: 3386677 - protein, 17 aa, Plasmodium falciparum
KLLFAISNDLKLFDIRV

SEQ ID NO: 3386678 - protein, 19 aa, Plasmodium falciparum
KLLFLSKDITHHIFQNVLT

SEQ ID NO: 3386679 - protein, 25 aa, Plasmodium falciparum
KLLGSFDLVGIPPAPRGVPQIEVTF

SEQ ID NO: 3386680 - protein, 33 aa, Plasmodium falciparum
KLLHAYKILLYLRYPFYLVKKKNPMLFYISESK

SEQ ID NO: 3386681 - protein, 17 aa, Plasmodium falciparum
KLLIKSEMLFYILSVQI

SEQ ID NO: 3386682 - protein, 23 aa, Plasmodium falciparum
KLLINQIQALNKNKPLLSSYSKI

SEQ ID NO: 3386683 - protein, 31 aa, Plasmodium falciparum
KLLKDFAKSFDPMFIIIRKRYRKDNLSAMYL

SEQ ID NO: 3386684 - protein, 19 aa, Plasmodium falciparum
KLLKGVCIAFYGLYGLLHN

SEQ ID NO: 3386685 - protein, 19 aa, Plasmodium falciparum
KLLKKKLIVIGLTQVIKCI

SEQ ID NO: 3386686 - protein, 24 aa, Plasmodium falciparum
KLLKKVLERVIPPTLLKIVTFEQI

SEQ ID NO: 3386687 - protein, 33 aa, Plasmodium falciparum
KLLKKYKIQGILPKKIFLIIKYSLDVDECVHNL

SEQ ID NO: 3386688 - protein, 29 aa, Plasmodium falciparum
KLLLDKEPFFFSIQLPNMLPALLSKEEEE

SEQ ID NO: 3386689 - protein, 17 aa, Plasmodium falciparum
KLLNFYCTLIKKGKYDN

SEQ ID NO: 3386690 - protein, 27 aa, Plasmodium falciparum
KLLNKIRLYITRYKILSKTKIKNKFPS

SEQ ID NO: 3386691 - protein, 20 aa, Plasmodium falciparum
KLLNYLIHCKTSYKKELKKL

SEQ ID NO: 3386692 - protein, 32 aa, Plasmodium falciparum
KLLQNNQHYIYIYIFQIEKYPKMASDIFFLTQ

SEQ ID NO: 3386693 - protein, 17 aa, Plasmodium falciparum
KLLQSVTLDWSNLTLNS

SEQ ID NO: 3386694 - protein, 21 aa, Plasmodium falciparum
KLLSDQLHLDSLYKTSDGRNK

SEQ ID NO: 3386695 - protein, 35 aa, Plasmodium falciparum
KLLYHINKNLIFLKRIQQYFYQKYINIKFSNDTND

SEQ ID NO: 3386696 - protein, 25 aa, Plasmodium falciparum
KLMLNKIIYPLFINNKLINTNVSSD

SEQ ID NO: 3386697 - protein, 20 aa, Plasmodium falciparum
KLMYKYVEPTFSYLSTLQTS

SEQ ID NO: 3386698 - protein, 19 aa, Plasmodium falciparum
KLNCLKLEKTNEILEFNKT

SEQ ID NO: 3386699 - protein, 29 aa, Plasmodium falciparum
KLNDDKIFSYAIRQYYYNLNKCTLCDKEN

SEQ ID NO: 3386700 - protein, 24 aa, Plasmodium falciparum
KLNDKYPCLFNCSYYVDSMKTIKY

SEQ ID NO: 3386701 - protein, 27 aa, Plasmodium falciparum
KLNDLKKKILIKKYLNEIALKKKNHVM

SEQ ID NO: 3386702 - protein, 21 aa, Plasmodium falciparum
KLNDRFYQICCKSIADINTHN

SEQ ID NO: 3386703 - protein, 20 aa, Plasmodium falciparum
KLNDSSYYSLKLPKFIDVCL

SEQ ID NO: 3386704 - protein, 22 aa, Plasmodium falciparum
KLNEDIFLLNDTSTFIYDEDFD

SEQ ID NO: 3386705 - protein, 24 aa, Plasmodium falciparum
KLNELRIILKEIPIMCLTATCTKN

SEQ ID NO: 3386706 - protein, 18 aa, Plasmodium falciparum
KLNGDIWQYKDPSGNVQG

SEQ ID NO: 3386707 - protein, 20 aa, Plasmodium falciparum
KLNHAVFIDKSLHSKILECK

SEQ ID NO: 3386708 - protein, 19 aa, Plasmodium falciparum
KLNHFIFQNHTKLFKYHDI

SEQ ID NO: 3386709 - protein, 18 aa, Plasmodium falciparum
KLNILVNSISKLVQSKIK

SEQ ID NO: 3386710 - protein, 24 aa, Plasmodium falciparum
KLNKKLIPIIQYKTDPYILGGLIL

SEQ ID NO: 3386711 - protein, 56 aa, Plasmodium falciparum
KLNKKRKKKIPGRIYKVIVRGKECWRAEWLVHSKNDDLRTLHPKLAGLNNDKLNFH

SEQ ID NO: 3386712 - protein, 25 aa, Plasmodium falciparum
KLNKNNLLSYIFKEEYNNIVNTKKK

SEQ ID NO: 3386713 - protein, 26 aa, Plasmodium falciparum
KLNKNYQDLFLFKDNFNVCEEDMDTI

SEQ ID NO: 3386714 - protein, 19 aa, Plasmodium falciparum
KLNLTHLCYAFSLIKIPKF

SEQ ID NO: 3386715 - protein, 27 aa, Plasmodium falciparum
KLNMDCQNIFIQKGDYKKVLNQMGEKA

SEQ ID NO: 3386716 - protein, 19 aa, Plasmodium falciparum
KLNMNVHLSWLKEKYKKEY

SEQ ID NO: 3386717 - protein, 20 aa, Plasmodium falciparum
KLNNFFVVKYVIYLKKKKKN

SEQ ID NO: 3386718 - protein, 22 aa, Plasmodium falciparum
KLNNIPYLKKLKTLILCNNKIA

SEQ ID NO: 3386719 - protein, 20 aa, Plasmodium falciparum
KLNNLYYKNKYNPVKDKNVS

SEQ ID NO: 3386720 - protein, 33 aa, Plasmodium falciparum
KLNSIFNMATNVLNNSFFYLSKEHDHKKNNHDT

SEQ ID NO: 3386721 - protein, 25 aa, Plasmodium falciparum
KLNYNRDPLLIFEFEKYLNIVKNKI

SEQ ID NO: 3386722 - protein, 17 aa, Plasmodium falciparum
KLPFEYSSFISNKLGST

SEQ ID NO: 3386723 - protein, 25 aa, Plasmodium falciparum
KLPFGWRVHILLPQDISAKMLKKQK

SEQ ID NO: 3386724 - protein, 17 aa, Plasmodium falciparum
KLPINKNLNDKQAFEGE

SEQ ID NO: 3386725 - protein, 30 aa, Plasmodium falciparum
KLQEILEMYEPPIIVFVNQKKVADIISKSI

SEQ ID NO: 3386726 - protein, 17 aa, Plasmodium falciparum
KLQIRLSHNYPNTCPEV

SEQ ID NO: 3386727 - protein, 24 aa, Plasmodium falciparum
KLQWEDKWILHKLNVYIKNANDNF

SEQ ID NO: 3386728 - protein, 24 aa, Plasmodium falciparum
KLRALFEMCFLISPATYNCVQDFK

SEQ ID NO: 3386729 - protein, 23 aa, Plasmodium falciparum
KLRHLKYSFLEYKIALENIVSCC

SEQ ID NO: 3386730 - protein, 17 aa, Plasmodium falciparum
KLRNKYLESLLNNNINN

SEQ ID NO: 3386731 - protein, 20 aa, Plasmodium falciparum
KLRNVMYFYMSHPNIRSFSL

SEQ ID NO: 3386732 - protein, 17 aa, Plasmodium falciparum
KLRQHYLNILQNKCKDI

SEQ ID NO: 3386733 - protein, 23 aa, Plasmodium falciparum
KLRSKILFNVKKVGKYIFKIYEC

SEQ ID NO: 3386734 - protein, 18 aa, Plasmodium falciparum
KLRYNIFVTRFLESNGLS

SEQ ID NO: 3386735 - protein, 26 aa, Plasmodium falciparum
KLSDKVMRMFGQELVLINSQILELSS

SEQ ID NO: 3386736 - protein, 28 aa, Plasmodium falciparum
KLSEHPFGFFFFYFYNRGSLLVMGGKAV

SEQ ID NO: 3386737 - protein, 31 aa, Plasmodium falciparum
KLSEPAHEESIYFTYRSVTPCDMNKLDETAK

SEQ ID NO: 3386738 - protein, 31 aa, Plasmodium falciparum
KLSEYIVAKEQMLYILRVMGYDEIDNIYFHP

SEQ ID NO: 3386739 - protein, 21 aa, Plasmodium falciparum
KLSFQEFMIVPVGAPSFKEAL

SEQ ID NO: 3386740 - protein, 24 aa, Plasmodium falciparum
KLSGKHYNYIFEKNNINKTPLDYI

SEQ ID NO: 3386741 - protein, 20 aa, Plasmodium falciparum
KLSLFSLQRNVVYNNLNNIL

SEQ ID NO: 3386742 - protein, 24 aa, Plasmodium falciparum
KLSLLKYDYMCQLSFLQSSILQKL

SEQ ID NO: 3386743 - protein, 26 aa, Plasmodium falciparum
KLSMQNRINFVCDELNHLIKKTLKSE

SEQ ID NO: 3386744 - protein, 19 aa, Plasmodium falciparum
KLSNLKYYRIPNFFRNKSE

SEQ ID NO: 3386745 - protein, 24 aa, Plasmodium falciparum
KLSNNYLEIYPLNIETFTYMNELF

SEQ ID NO: 3386746 - protein, 21 aa, Plasmodium falciparum
KLSRPPFYFKNEKDMINDTNG

SEQ ID NO: 3386747 - protein, 18 aa, Plasmodium falciparum
KLSSYNNLFLTLSKREMK

SEQ ID NO: 3386748 - protein, 33 aa, Plasmodium falciparum
KLSYNDMLLNLKKRNVLEEFPFNFVKQKDDSAK

SEQ ID NO: 3386749 - protein, 21 aa, Plasmodium falciparum
KLTFFQSFIHLYKEGGILYLY

SEQ ID NO: 3386750 - protein, 18 aa, Plasmodium falciparum
KLTFGGMFDKGPLYEEKK

SEQ ID NO: 3386751 - protein, 42 aa, Plasmodium falciparum
KLTIIGCQTLEWLHIFRNCSFPLLKKFEVCYYPLHHDHWYWN

SEQ ID NO: 3386752 - protein, 20 aa, Plasmodium falciparum
KLTILKYFNSYLLKNNKGKY

SEQ ID NO: 3386753 - protein, 19 aa, Plasmodium falciparum
KLTLFFAVKLYKKNIIRIK

SEQ ID NO: 3386754 - protein, 27 aa, Plasmodium falciparum
KLTNIHFLNLLYFKYQNINTKYLFIHN

SEQ ID NO: 3386755 - protein, 33 aa, Plasmodium falciparum
KLTNKYNNNYKLFKSFVFSLNNPINFSPSSKEQ

SEQ ID NO: 3386756 - protein, 17 aa, Plasmodium falciparum
KLTQYPFRKIASTAAIN

SEQ ID NO: 3386757 - protein, 25 aa, Plasmodium falciparum
KLTSKPMIYVPIKLQVDNLKNDANK

SEQ ID NO: 3386758 - protein, 28 aa, Plasmodium falciparum
KLTSNGCTFIFWIADWFAHLNNKMSGDL

SEQ ID NO: 3386759 - protein, 36 aa, Plasmodium falciparum
KLTVFNIPHLRYFFVSKDLNFIKWYSSRKQDDQCKI

SEQ ID NO: 3386760 - protein, 29 aa, Plasmodium falciparum
KLTYLGYDFLALRTFLKRGILKSIGNQIG

SEQ ID NO: 3386761 - protein, 21 aa, Plasmodium falciparum
KLVLYKIYDNLYNFQWINREN

SEQ ID NO: 3386762 - protein, 19 aa, Plasmodium falciparum
KLVPNWKKPIVIGRHAYAD

SEQ ID NO: 3386763 - protein, 21 aa, Plasmodium falciparum
KLVWLCLSYHHYYVRTIDLTV

SEQ ID NO: 3386764 - protein, 20 aa, Plasmodium falciparum
KLWNRFRNTQITTFKSKNAF

SEQ ID NO: 3386765 - protein, 19 aa, Plasmodium falciparum
KLWNYQEVYTYLKQNNISI

SEQ ID NO: 3386766 - protein, 17 aa, Plasmodium falciparum
KLWRTDRYLRHLEAVLI

SEQ ID NO: 3386767 - protein, 17 aa, Plasmodium falciparum
KLYELNLTINKNIINSN

SEQ ID NO: 3386768 - protein, 20 aa, Plasmodium falciparum
KLYLDAENLFYLLLDTHDIQ

SEQ ID NO: 3386769 - protein, 18 aa, Plasmodium falciparum
KLYLFQLVQSLRTFNYQH

SEQ ID NO: 3386770 - protein, 35 aa, Plasmodium falciparum
KLYLPVQSLYQIYLFYIYFNIYVKYLFTCYINYCN

SEQ ID NO: 3386771 - protein, 17 aa, Plasmodium falciparum
KLYNQNIYTLKYQVANI

SEQ ID NO: 3386772 - protein, 22 aa, Plasmodium falciparum
KLYRVFEKLNKLFYLPRCKPQE

SEQ ID NO: 3386773 - protein, 22 aa, Plasmodium falciparum
KLYRVQYIINNSIKTKGFSVKK

SEQ ID NO: 3386774 - protein, 21 aa, Plasmodium falciparum
KLYVLKKYDKIYKTCNYEKSV

SEQ ID NO: 3386775 - protein, 38 aa, Plasmodium falciparum
KMCEHPNVVKYFESFFWPPCYLVIVCEYLSGGTLYDLY

SEQ ID NO: 3386776 - protein, 18 aa, Plasmodium falciparum
KMCPYMNTKEKCKRFSNN

SEQ ID NO: 3386777 - protein, 27 aa, Plasmodium falciparum
KMCRQLAEVINFLHTPIKNKKNVIIHR

SEQ ID NO: 3386778 - protein, 40 aa, Plasmodium falciparum
KMDAYTFFIGTNRANALDLCQRLKLFEALHNFIKEQNNDN

SEQ ID NO: 3386779 - protein, 23 aa, Plasmodium falciparum
KMDNIYLGYNESSLFFVDTRLQR

SEQ ID NO: 3386780 - protein, 26 aa, Plasmodium falciparum
KMEETKNLIFPMDIKKIYGSLYKVKK

SEQ ID NO: 3386781 - protein, 20 aa, Plasmodium falciparum
KMETIQGKNLFLYQSSDVKH

SEQ ID NO: 3386782 - protein, 18 aa, Plasmodium falciparum
KMHILDIFKYHDFPMNMF

SEQ ID NO: 3386783 - protein, 20 aa, Plasmodium falciparum
KMHVFDLDKAKISIFKIFER

SEQ ID NO: 3386784 - protein, 20 aa, Plasmodium falciparum
KMIFVRHNIKIKCRLINIPY

SEQ ID NO: 3386785 - protein, 19 aa, Plasmodium falciparum
KMIFYPYNYDNNKYKRFSL

SEQ ID NO: 3386786 - protein, 17 aa, Plasmodium falciparum
KMIQTFSVFPLLTNESS

SEQ ID NO: 3386787 - protein, 27 aa, Plasmodium falciparum
KMIRKDYLHALVIWFDISFSACHTEVN

SEQ ID NO: 3386788 - protein, 24 aa, Plasmodium falciparum
KMITLDNYIYLKRPIMKELISYAI

SEQ ID NO: 3386789 - protein, 42 aa, Plasmodium falciparum
KMKDLNFDILKWKELYIECICILRFLFFNCKLVHADFSEYNL

SEQ ID NO: 3386790 - protein, 27 aa, Plasmodium falciparum
KMKGNMEDLIKLNYITFEKNKIVIKLE

SEQ ID NO: 3386791 - protein, 18 aa, Plasmodium falciparum
KMKHIPLSVNNKGYNKSS

SEQ ID NO: 3386792 - protein, 17 aa, Plasmodium falciparum
KMKIHYPIYFGCGLTEN

SEQ ID NO: 3386793 - protein, 27 aa, Plasmodium falciparum
KMKKGFNSLVILIKSIAYIRSSVDIFC

SEQ ID NO: 3386794 - protein, 30 aa, Plasmodium falciparum
KMKSKGCIVKYIKPLWLIEEEKRIINELIE

SEQ ID NO: 3386795 - protein, 23 aa, Plasmodium falciparum
KMKYGMPEYYRCPYYMHENRNLY

SEQ ID NO: 3386796 - protein, 17 aa, Plasmodium falciparum
KMLRNELFLYNPEYLNK

SEQ ID NO: 3386797 - protein, 19 aa, Plasmodium falciparum
KMMKIYNHSLNKYKNLINF

SEQ ID NO: 3386798 - protein, 23 aa, Plasmodium falciparum
KMNCSEHLNIVPINHNNNNIMCS

SEQ ID NO: 3386799 - protein, 25 aa, Plasmodium falciparum
KMNDGILMQINKLSQYSSKWIIKAR

SEQ ID NO: 3386800 - protein, 27 aa, Plasmodium falciparum
KMNISTLCNILYYYTKLNISNDDIINL

SEQ ID NO: 3386801 - protein, 28 aa, Plasmodium falciparum
KMNKSIFKVLNTVMFIGTIHSFCRYILY

SEQ ID NO: 3386802 - protein, 27 aa, Plasmodium falciparum
KMNRNKILYLKGLKSKELLLQKKIDYQ

SEQ ID NO: 3386803 - protein, 19 aa, Plasmodium falciparum
KMNTVDTYIPCDINENKKE

SEQ ID NO: 3386804 - protein, 19 aa, Plasmodium falciparum
KMQGRGTYFFADGGIYEGD

SEQ ID NO: 3386805 - protein, 24 aa, Plasmodium falciparum
KMSKNLPGLYDHYAFLLLNQNKCE

SEQ ID NO: 3386806 - protein, 28 aa, Plasmodium falciparum
KMSLKRNIWYNNRSNSVHSALNGALNSN

SEQ ID NO: 3386807 - protein, 30 aa, Plasmodium falciparum
KMSNMKNVDMLLLLLSNNIYNKIMSTTLYN

SEQ ID NO: 3386808 - protein, 20 aa, Plasmodium falciparum
KMSYESISLLNNFSYTLDNS

SEQ ID NO: 3386809 - protein, 18 aa, Plasmodium falciparum
KMTILKMIIKYENFNSIM

SEQ ID NO: 3386810 - protein, 17 aa, Plasmodium falciparum
KMVCKKLDQIVLNYESI

SEQ ID NO: 3386811 - protein, 23 aa, Plasmodium falciparum
KMVEFHYLFTPSDYEYGSFIMMG

SEQ ID NO: 3386812 - protein, 18 aa, Plasmodium falciparum
KMVGIKKIVLLKEKQKSL

SEQ ID NO: 3386813 - protein, 23 aa, Plasmodium falciparum
KMVPLPRYCCVNGIPLSDFTKKG

SEQ ID NO: 3386814 - protein, 25 aa, Plasmodium falciparum
KMYAKAFFELYFMEKYKRNEGVIKV

SEQ ID NO: 3386815 - protein, 18 aa, Plasmodium falciparum
KMYDIILSSEYTGLPIEH

SEQ ID NO: 3386816 - protein, 27 aa, Plasmodium falciparum
KNADNIIPKWLYFVKGVIDCEDMPLNI

SEQ ID NO: 3386817 - protein, 27 aa, Plasmodium falciparum
KNAKIAFLDFPLKQYRLHLGVQVNIND

SEQ ID NO: 3386818 - protein, 44 aa, Plasmodium falciparum
KNAKYNFVPVIIDWGLIKQLDSVMKFAFCKLVYNISCMNVLNII

SEQ ID NO: 3386819 - protein, 26 aa, Plasmodium falciparum
KNALFLYCKYVLLFYGKELLNENNVE

SEQ ID NO: 3386820 - protein, 26 aa, Plasmodium falciparum
KNCGNIFHYNCMIKWMELQKSCPLCK

SEQ ID NO: 3386821 - protein, 21 aa, Plasmodium falciparum
KNCIYAFIKYYDTLQNDLFNE

SEQ ID NO: 3386822 - protein, 25 aa, Plasmodium falciparum
KNCKQLFDIIILDPPNLIPKSKFLE

SEQ ID NO: 3386823 - protein, 23 aa, Plasmodium falciparum
KNCLCHEFVFPNFLTDRQKYKLI

SEQ ID NO: 3386824 - protein, 28 aa, Plasmodium falciparum
KNCLYNFIHTVVFFKLDLGTIHVPKKKS

SEQ ID NO: 3386825 - protein, 28 aa, Plasmodium falciparum
KNCRSGKIIGEPFPLDVVSRNKYCVEKG

SEQ ID NO: 3386826 - protein, 60 aa, Plasmodium falciparum
KNCVDYYIDILFSYTGFCDIIFSVTCGIYRKKYTCYNISTIPWFGYKNWGVLKNCMKKDM

SEQ ID NO: 3386827 - protein, 33 aa, Plasmodium falciparum
KNDDTFINIIYTNKNLFYKKKNVKWIDGFIIEK

SEQ ID NO: 3386828 - protein, 17 aa, Plasmodium falciparum
KNDENLFTTFSNAFHIP

SEQ ID NO: 3386829 - protein, 23 aa, Plasmodium falciparum
KNDFIPPVILVLNKVDLCTHNKW

SEQ ID NO: 3386830 - protein, 23 aa, Plasmodium falciparum
KNDFLGINCYIDDIGRIKKLPYN

SEQ ID NO: 3386831 - protein, 34 aa, Plasmodium falciparum
KNDGIYKNRGIYKNQFLYNFYTNDDVIYIKQITE

SEQ ID NO: 3386832 - protein, 23 aa, Plasmodium falciparum
KNDHFYKIFFSSKKVKIIKSQNH

SEQ ID NO: 3386833 - protein, 25 aa, Plasmodium falciparum
KNDITYIFYIMKEHLIYTLKEIFKK

SEQ ID NO: 3386834 - protein, 23 aa, Plasmodium falciparum
KNDKIIYAQMRRSQSDNLYKRKN

SEQ ID NO: 3386835 - protein, 37 aa, Plasmodium falciparum
KNDKITNIIIYKRMYQSFILLKKEYRDLIDEHKKKIN

SEQ ID NO: 3386836 - protein, 23 aa, Plasmodium falciparum
KNDKNLILFYNYYFNYVFDHMYL

SEQ ID NO: 3386837 - protein, 23 aa, Plasmodium falciparum
KNDKTFSNLFLLNNNISINKKKI

SEQ ID NO: 3386838 - protein, 24 aa, Plasmodium falciparum
KNDLSTVQLLLKKYPQLIQKGHNL

SEQ ID NO: 3386839 - protein, 28 aa, Plasmodium falciparum
KNDNHFCIVPFNSTNNFIISKKSFVTKN

SEQ ID NO: 3386840 - protein, 26 aa, Plasmodium falciparum
KNDNNIFLKYFLQKFTIHQIEEKKVK

SEQ ID NO: 3386841 - protein, 32 aa, Plasmodium falciparum
KNDSEKYWDNPPLHYSKKNNYDIFTLGDIKKY

SEQ ID NO: 3386842 - protein, 22 aa, Plasmodium falciparum
KNDVLVIFKKIIEYIDSPVHFS

SEQ ID NO: 3386843 - protein, 25 aa, Plasmodium falciparum
KNDVMSFNEYSLNPGLSMDDFYKNM

SEQ ID NO: 3386844 - protein, 26 aa, Plasmodium falciparum
KNDVSYFRQIKKYDYLIFDEAHFLKN

SEQ ID NO: 3386845 - protein, 19 aa, Plasmodium falciparum
KNDYNFSYKNYKERYYYDK

SEQ ID NO: 3386846 - protein, 29 aa, Plasmodium falciparum
KNDYVSLSNNFFLIKNRSYKYITVRNKIG

SEQ ID NO: 3386847 - protein, 20 aa, Plasmodium falciparum
KNECNFVYYQNYNNTNNVII

SEQ ID NO: 3386848 - protein, 25 aa, Plasmodium falciparum
KNEEDNFFFVFDDKEINKLNKIKEE

SEQ ID NO: 3386849 - protein, 26 aa, Plasmodium falciparum
KNEEHIYINKNIWKDKFDNCYNICND

SEQ ID NO: 3386850 - protein, 48 aa, Plasmodium falciparum
KNEEQIIPYLNVFGDYIQRCILPTDLPYAELYVLIDSLIHNEILPSYD

SEQ ID NO: 3386851 - protein, 25 aa, Plasmodium falciparum
KNEESYIKVLKYFKSLSPSGIHYNI

SEQ ID NO: 3386852 - protein, 36 aa, Plasmodium falciparum
KNEFGKVMTPKESFRYISWIFHGKKQGKNKLEKKIK

SEQ ID NO: 3386853 - protein, 19 aa, Plasmodium falciparum
KNEILYKSKINEAQALLIF

SEQ ID NO: 3386854 - protein, 19 aa, Plasmodium falciparum
KNEKIEPSLLLNLTETNTL

SEQ ID NO: 3386855 - protein, 31 aa, Plasmodium falciparum
KNEKNLFSSLILLIKTKRRYHRNFFVTNKDN

SEQ ID NO: 3386856 - protein, 25 aa, Plasmodium falciparum
KNEKSFIDLNFIKGYSNFIKKKCVP

SEQ ID NO: 3386857 - protein, 26 aa, Plasmodium falciparum
KNEKSFIDLNFIKGYSNFIKKKCVPY

SEQ ID NO: 3386858 - protein, 28 aa, Plasmodium falciparum
KNEKYDECWFLFQHYFERSSDVRKEMVH

SEQ ID NO: 3386859 - protein, 18 aa, Plasmodium falciparum
KNEKYRGKYHKYPLDIEA

SEQ ID NO: 3386860 - protein, 18 aa, Plasmodium falciparum
KNELENLVPYFNGRIFLE

SEQ ID NO: 3386861 - protein, 18 aa, Plasmodium falciparum
KNELLERLLKHEEKDNIN

SEQ ID NO: 3386862 - protein, 26 aa, Plasmodium falciparum
KNELNIFFNLIYILNEKYRTKISLIS

SEQ ID NO: 3386863 - protein, 18 aa, Plasmodium falciparum
KNELQNIYIFKKKKKKKK

SEQ ID NO: 3386864 - protein, 39 aa, Plasmodium falciparum
KNELTKAIILEIIIHNGYLLYHKFGDLLNERKKIKMIIL

SEQ ID NO: 3386865 - protein, 25 aa, Plasmodium falciparum
KNENFQNFVLEEIATIKNGLIMESQ

SEQ ID NO: 3386866 - protein, 17 aa, Plasmodium falciparum
KNENILYSIQYKMNTLI

SEQ ID NO: 3386867 - protein, 27 aa, Plasmodium falciparum
KNENKLKNYILILRDYENLCNDKIFNC

SEQ ID NO: 3386868 - protein, 25 aa, Plasmodium falciparum
KNEPSEIDFFKFVKKMILKCNKNDS

SEQ ID NO: 3386869 - protein, 23 aa, Plasmodium falciparum
KNEPVFFQIVKPEVRVLNNSISF

SEQ ID NO: 3386870 - protein, 24 aa, Plasmodium falciparum
KNESFFNYYINQKILKSCEIDNFM

SEQ ID NO: 3386871 - protein, 23 aa, Plasmodium falciparum
KNETKEHPTVNPVFNNNDIKQNI

SEQ ID NO: 3386872 - protein, 21 aa, Plasmodium falciparum
KNEVDEFLLVSRIAHVDLCNQ

SEQ ID NO: 3386873 - protein, 20 aa, Plasmodium falciparum
KNEYNWLRSLDTNEYDTKWD

SEQ ID NO: 3386874 - protein, 19 aa, Plasmodium falciparum
KNFILKLRVPCDQKKNKNC

SEQ ID NO: 3386875 - protein, 19 aa, Plasmodium falciparum
KNFLEYFERSWLSEDEFVL

SEQ ID NO: 3386876 - protein, 20 aa, Plasmodium falciparum
KNFMDLFMDTDMFEKKMNEE

SEQ ID NO: 3386877 - protein, 18 aa, Plasmodium falciparum
KNFPRQWNKNNITLSKNQ

SEQ ID NO: 3386878 - protein, 27 aa, Plasmodium falciparum
KNFYTTYIFDIYGKKIDILYQHLSYII

SEQ ID NO: 3386879 - protein, 27 aa, Plasmodium falciparum
KNGKITQSIFDIIYNHYVNDINQNIVK

SEQ ID NO: 3386880 - protein, 25 aa, Plasmodium falciparum
KNGLYCSPLRLLAWEVYSKLTRMNK

SEQ ID NO: 3386881 - protein, 24 aa, Plasmodium falciparum
KNGNFIEFPFNGLRIMTVIGNCLI

SEQ ID NO: 3386882 - protein, 21 aa, Plasmodium falciparum
KNGYHILYLTARAIGQADSTR

SEQ ID NO: 3386883 - protein, 21 aa, Plasmodium falciparum
KNGYLEALLRGFRSSFLTPEE

SEQ ID NO: 3386884 - protein, 31 aa, Plasmodium falciparum
KNHENDFFYTNLLYYLMDIYINKMEYIDNQY

SEQ ID NO: 3386885 - protein, 55 aa, Plasmodium falciparum
KNHENMFRMSKSQLLSLESDIKYLQSLTSYMIKPKDLYFETFEEIDVFSYDKNDE

SEQ ID NO: 3386886 - protein, 21 aa, Plasmodium falciparum
KNHIFNTLKDSTTKSNIYNLI

SEQ ID NO: 3386887 - protein, 22 aa, Plasmodium falciparum
KNHINLFKIPNFFMTTSNELSE

SEQ ID NO: 3386888 - protein, 24 aa, Plasmodium falciparum
KNHKWNIFINIYVYEYTPYIYDHI

SEQ ID NO: 3386889 - protein, 21 aa, Plasmodium falciparum
KNHLFGLNYFVKKIIQLNDIM

SEQ ID NO: 3386890 - protein, 19 aa, Plasmodium falciparum
KNIAKEHSLKKIEKNINLL

SEQ ID NO: 3386891 - protein, 36 aa, Plasmodium falciparum
KNIDEFITYIYLYKGKRFRVILSILLKNILHHIDNV

SEQ ID NO: 3386892 - protein, 25 aa, Plasmodium falciparum
KNIDEVDWFLPTQVPKRWLSRNPAD

SEQ ID NO: 3386893 - protein, 23 aa, Plasmodium falciparum
KNIDIRIIPPLRTQQVLNSFKSF

SEQ ID NO: 3386894 - protein, 28 aa, Plasmodium falciparum
KNIDKCLKPYLPLLSYLMFETDIVVNNK

SEQ ID NO: 3386895 - protein, 27 aa, Plasmodium falciparum
KNIEFFIPLLAEYYINKSKLLLSSIHW

SEQ ID NO: 3386896 - protein, 22 aa, Plasmodium falciparum
KNIEIFKIASLYIIAAFNADIK

SEQ ID NO: 3386897 - protein, 21 aa, Plasmodium falciparum
KNIFNRFNPFTLPLLGKNKLC

SEQ ID NO: 3386898 - protein, 18 aa, Plasmodium falciparum
KNIGFLKDYRRLNVAVTR

SEQ ID NO: 3386899 - protein, 21 aa, Plasmodium falciparum
KNIGFVNCFILRNNKIRWGKK

SEQ ID NO: 3386900 - protein, 21 aa, Plasmodium falciparum
KNIIIGKRNIIFPSCYMKCDK

SEQ ID NO: 3386901 - protein, 33 aa, Plasmodium falciparum
KNIINYLNFDRTIYFIFNQIKKLIKKLKNIFIS

SEQ ID NO: 3386902 - protein, 17 aa, Plasmodium falciparum
KNIISLFIKIFMSTNNT

SEQ ID NO: 3386903 - protein, 30 aa, Plasmodium falciparum
KNIKDMIPMSFINFIIHYNSLYQINNQLLL

SEQ ID NO: 3386904 - protein, 28 aa, Plasmodium falciparum
KNIKINDILYRYRKFQIPPLVQSNNKKT

SEQ ID NO: 3386905 - protein, 30 aa, Plasmodium falciparum
KNIKKDILYSIIYPYKFRLSNLNCIINIFG

SEQ ID NO: 3386906 - protein, 26 aa, Plasmodium falciparum
KNIKLDSILARGFNKSILKEIETNTN

SEQ ID NO: 3386907 - protein, 19 aa, Plasmodium falciparum
KNIKYLYSYSYIKKNILID

SEQ ID NO: 3386908 - protein, 21 aa, Plasmodium falciparum
KNIKYMYNLKDAYCLKKVNTK

SEQ ID NO: 3386909 - protein, 32 aa, Plasmodium falciparum
KNIKYNKDILKKKNINFLINKNFTSHISSSSF

SEQ ID NO: 3386910 - protein, 21 aa, Plasmodium falciparum
KNILNFIKPDDMYINSYIPYP

SEQ ID NO: 3386911 - protein, 22 aa, Plasmodium falciparum
KNILPTSLALQNLFYKLHTVNE

SEQ ID NO: 3386912 - protein, 18 aa, Plasmodium falciparum
KNIMLKNEDLKKLLDEYK

SEQ ID NO: 3386913 - protein, 21 aa, Plasmodium falciparum
KNIMYPYFRMYKSPYRARDSR

SEQ ID NO: 3386914 - protein, 24 aa, Plasmodium falciparum
KNINIDILKKQILHVSNKLNLMCD

SEQ ID NO: 3386915 - protein, 22 aa, Plasmodium falciparum
KNINIIWDPFCSTGNLIFELLS

SEQ ID NO: 3386916 - protein, 26 aa, Plasmodium falciparum
KNINLFSMRVIEWYSWHFPELKKIVT

SEQ ID NO: 3386917 - protein, 24 aa, Plasmodium falciparum
KNINNPMRMLVPGKAASFLIGRKG

SEQ ID NO: 3386918 - protein, 24 aa, Plasmodium falciparum
KNINRWHKLIDSLIYFEDAEWKKN

SEQ ID NO: 3386919 - protein, 33 aa, Plasmodium falciparum
KNINYPFVHIILYFYFKLNYINETFVFKLLNHY

SEQ ID NO: 3386920 - protein, 30 aa, Plasmodium falciparum
KNIPPKGMPKPLYSFIKNKDLNRNPINYDA

SEQ ID NO: 3386921 - protein, 27 aa, Plasmodium falciparum
KNIPQKKSLLFMKKATTGIKKVSVSKS

SEQ ID NO: 3386922 - protein, 24 aa, Plasmodium falciparum
KNIQAFHQILIKKIIEEKYITQFL

SEQ ID NO: 3386923 - protein, 26 aa, Plasmodium falciparum
KNIQNYFFFYDYRKCIYNVDGKIYIQ

SEQ ID NO: 3386924 - protein, 28 aa, Plasmodium falciparum
KNIQRKNEFIFLWPKTFHGGFNSGYNCN

SEQ ID NO: 3386925 - protein, 25 aa, Plasmodium falciparum
KNIRGLNKCLFLYKGVRNIRNRYNL

SEQ ID NO: 3386926 - protein, 21 aa, Plasmodium falciparum
KNISYRNSILTRLLQDSLGGS

SEQ ID NO: 3386927 - protein, 25 aa, Plasmodium falciparum
KNIVIQMPYACKLLFQELQTMNVFP

SEQ ID NO: 3386928 - protein, 20 aa, Plasmodium falciparum
KNIYCINFKKYYKSLQRKRK

SEQ ID NO: 3386929 - protein, 18 aa, Plasmodium falciparum
KNIYLNNNYMKILKNEEA

SEQ ID NO: 3386930 - protein, 17 aa, Plasmodium falciparum
KNIYPFFKTEEDVTYGR

SEQ ID NO: 3386931 - protein, 30 aa, Plasmodium falciparum
KNIYVIEHIDKIYYDTFLNKNPSEKSVFMN

SEQ ID NO: 3386932 - protein, 24 aa, Plasmodium falciparum
KNKAVLKPNPRFVGDNPNPFMQPP

SEQ ID NO: 3386933 - protein, 44 aa, Plasmodium falciparum
KNKDHNIKLLYNHLYLIKQREAHILRVRNYKVGYLNKGNHISRK

SEQ ID NO: 3386934 - protein, 19 aa, Plasmodium falciparum
KNKDHTIKFFASPKKTKKN

SEQ ID NO: 3386935 - protein, 26 aa, Plasmodium falciparum
KNKDSLIMFLVEIFRSLFVSNCIDKN

SEQ ID NO: 3386936 - protein, 22 aa, Plasmodium falciparum
KNKEDIYILQVEKQTLIKVISS

SEQ ID NO: 3386937 - protein, 29 aa, Plasmodium falciparum
KNKEFLVNRTNSLNIKRVRSGPLDNSQNV

SEQ ID NO: 3386938 - protein, 24 aa, Plasmodium falciparum
KNKEGGLLYEWYNKYIYNGDGKEK

SEQ ID NO: 3386939 - protein, 24 aa, Plasmodium falciparum
KNKEKYVHIVQSLTNQHILLNDYQ

SEQ ID NO: 3386940 - protein, 25 aa, Plasmodium falciparum
KNKELSPLSLIKKHGRLINNIEEIY

SEQ ID NO: 3386941 - protein, 23 aa, Plasmodium falciparum
KNKENYLFNFWNLHIDNVSNEKT

SEQ ID NO: 3386942 - protein, 17 aa, Plasmodium falciparum
KNKFDLIRRRNRKKSIN

SEQ ID NO: 3386943 - protein, 17 aa, Plasmodium falciparum
KNKFYNLDYDKETVSKT

SEQ ID NO: 3386944 - protein, 25 aa, Plasmodium falciparum
KNKIEQINLPYLPKLKKLSVQHNRL

SEQ ID NO: 3386945 - protein, 22 aa, Plasmodium falciparum
KNKIKLHFIHFYNVILYQYNNV

SEQ ID NO: 3386946 - protein, 20 aa, Plasmodium falciparum
KNKILAIPNYEEKQYYIVTN

SEQ ID NO: 3386947 - protein, 24 aa, Plasmodium falciparum
KNKKINILYFIDVSKFHVFEQLLL

SEQ ID NO: 3386948 - protein, 34 aa, Plasmodium falciparum
KNKKINIRDLDLDIYYPLLHVEQIKFRQSNQEQN

SEQ ID NO: 3386949 - protein, 24 aa, Plasmodium falciparum
KNKKNIFSYFKNICKRKKYKINSK

SEQ ID NO: 3386950 - protein, 33 aa, Plasmodium falciparum
KNKKQFYNLPTSYLNIWRWCNKRQFKSLFHYYD

SEQ ID NO: 3386951 - protein, 20 aa, Plasmodium falciparum
KNKKRNFFFSFNTDSEDYNN

SEQ ID NO: 3386952 - protein, 50 aa, Plasmodium falciparum
KNKKRNIYHLFLEYNQNVLLVQKYLKKKKILIKYINQLFEKHVLPSYNSS

SEQ ID NO: 3386953 - protein, 17 aa, Plasmodium falciparum
KNKLLFAISNDLKLFDI

SEQ ID NO: 3386954 - protein, 25 aa, Plasmodium falciparum
KNKLNITLFERLINKHKQNISFLLN

SEQ ID NO: 3386955 - protein, 26 aa, Plasmodium falciparum
KNKLPSLRKIVLMATKYSIPIPAFSA

SEQ ID NO: 3386956 - protein, 26 aa, Plasmodium falciparum
KNKLYGLIMNIIKKSLFVNYDKFMIK

SEQ ID NO: 3386957 - protein, 27 aa, Plasmodium falciparum
KNKNDLIVKIPFRTLSLKLPNAPVFKS

SEQ ID NO: 3386958 - protein, 24 aa, Plasmodium falciparum
KNKNDVIYNIPYNTNSFIDTKQNM

SEQ ID NO: 3386959 - protein, 45 aa, Plasmodium falciparum
KNKNFLKSSLSRHSLVILSIIYVLFHQNVFTSKWNEPSVLQLVNT

SEQ ID NO: 3386960 - protein, 26 aa, Plasmodium falciparum
KNKNIKLIKVPKFVSNKWLQYNNKDI

SEQ ID NO: 3386961 - protein, 24 aa, Plasmodium falciparum
KNKNKYILLLNELLSLFPAHAEKS

SEQ ID NO: 3386962 - protein, 23 aa, Plasmodium falciparum
KNKNLFFILTYMSGVQKCIYDHA

SEQ ID NO: 3386963 - protein, 23 aa, Plasmodium falciparum
KNKNNFHLFNRNIPNVYLKRAND

SEQ ID NO: 3386964 - protein, 21 aa, Plasmodium falciparum
KNKNYWSHMNLKRSEKKTLKE

SEQ ID NO: 3386965 - protein, 24 aa, Plasmodium falciparum
KNKQLLFLTATWPEQVRKLAYDFC

SEQ ID NO: 3386966 - protein, 23 aa, Plasmodium falciparum
KNKRIKKFFYNKEKHHELLSQLH

SEQ ID NO: 3386967 - protein, 25 aa, Plasmodium falciparum
KNKSEESFLYKYNIHNILKNKHFSN

SEQ ID NO: 3386968 - protein, 34 aa, Plasmodium falciparum
KNKSELKFYISNNIPFFIFAQQRKIFPTICNGEQ

SEQ ID NO: 3386969 - protein, 31 aa, Plasmodium falciparum
KNKSIYKRCYLNIRNLYLVKKNDKIKFENKL

SEQ ID NO: 3386970 - protein, 30 aa, Plasmodium falciparum
KNKSMIKDFLFFGVIDKKGQNYLGRIYMII

SEQ ID NO: 3386971 - protein, 22 aa, Plasmodium falciparum
KNKTFTDRFLNLKHQSYNSQDT

SEQ ID NO: 3386972 - protein, 19 aa, Plasmodium falciparum
KNKVYCPIELKNVYTLLED

SEQ ID NO: 3386973 - protein, 26 aa, Plasmodium falciparum
KNKYLAEIIRCELIWGPTKNKEPITP

SEQ ID NO: 3386974 - protein, 24 aa, Plasmodium falciparum
KNKYNEFFLWSTKCVDLEPSILLE

SEQ ID NO: 3386975 - protein, 17 aa, Plasmodium falciparum
KNKYQEELKRNKTLQFL

SEQ ID NO: 3386976 - protein, 19 aa, Plasmodium falciparum
KNKYVILKYDEDSLIEALE

SEQ ID NO: 3386977 - protein, 23 aa, Plasmodium falciparum
KNLCIQFFVTLKNVFIKSTNKFT

SEQ ID NO: 3386978 - protein, 20 aa, Plasmodium falciparum
KNLCSFKLSLQIEKYAKKNN

SEQ ID NO: 3386979 - protein, 29 aa, Plasmodium falciparum
KNLDVNKKNLLLNKLKDYYNNNNNNIFLI

SEQ ID NO: 3386980 - protein, 27 aa, Plasmodium falciparum
KNLENLYFDFPYNKNQIIFKPVFYPYK

SEQ ID NO: 3386981 - protein, 25 aa, Plasmodium falciparum
KNLERIIQYLFNGTLICSNVDLCKK

SEQ ID NO: 3386982 - protein, 19 aa, Plasmodium falciparum
KNLIFYYGHKKSVTCVASP

SEQ ID NO: 3386983 - protein, 26 aa, Plasmodium falciparum
KNLKDIELFNKWKKGMILLSNENGIV

SEQ ID NO: 3386984 - protein, 22 aa, Plasmodium falciparum
KNLKEKIPYHMKNKYLVMSSQN

SEQ ID NO: 3386985 - protein, 28 aa, Plasmodium falciparum
KNLKHLKVIFLLRPTYTNILRLMSELKK

SEQ ID NO: 3386986 - protein, 20 aa, Plasmodium falciparum
KNLKIVKCVCYALLGKYDNK

SEQ ID NO: 3386987 - protein, 25 aa, Plasmodium falciparum
KNLKKFVNYLKYVKDIHSCSYFISL

SEQ ID NO: 3386988 - protein, 23 aa, Plasmodium falciparum
KNLKKLLEIEYKMKKKIESFEKN

SEQ ID NO: 3386989 - protein, 26 aa, Plasmodium falciparum
KNLLHYAEIFKPFVSLRKLNYNFVEE

SEQ ID NO: 3386990 - protein, 17 aa, Plasmodium falciparum
KNLLKLFELDENKIISN

SEQ ID NO: 3386991 - protein, 45 aa, Plasmodium falciparum
KNLLTESIYAKLYKMYLTTLNNYYFILNILLPQISTHIIIHLLTF

SEQ ID NO: 3386992 - protein, 28 aa, Plasmodium falciparum
KNLNDTYIFNTFFYKKLELYDDVLKAYL

SEQ ID NO: 3386993 - protein, 28 aa, Plasmodium falciparum
KNLNTYFFHILYDYLFHVIKKENLYNIT

SEQ ID NO: 3386994 - protein, 21 aa, Plasmodium falciparum
KNLPKQWEYEFEEFSDDDSDD

SEQ ID NO: 3386995 - protein, 20 aa, Plasmodium falciparum
KNLPKVLGRILIPKTQKTGS

SEQ ID NO: 3386996 - protein, 24 aa, Plasmodium falciparum
KNLQQPVYLKYNKNVLYIDEKKSL

SEQ ID NO: 3386997 - protein, 27 aa, Plasmodium falciparum
KNLWENDIIHFFFDLVLRKKEHFKNNT

SEQ ID NO: 3386998 - protein, 24 aa, Plasmodium falciparum
KNLYEIVNILYTSNFDFSEYIMCD

SEQ ID NO: 3386999 - protein, 20 aa, Plasmodium falciparum
KNLYLVDQIYSLSPILDMKI

SEQ ID NO: 3387000 - protein, 21 aa, Plasmodium falciparum
KNLYYYYYRSLGVNQFKDVSN

SEQ ID NO: 3387001 - protein, 18 aa, Plasmodium falciparum
KNMCNILEYLNIKKAHFF

SEQ ID NO: 3387002 - protein, 22 aa, Plasmodium falciparum
KNMDRIPKNIPILFIHSKTDNI

SEQ ID NO: 3387003 - protein, 38 aa, Plasmodium falciparum
KNMDTAMNSLNMLILPKIKGVRFDKSGRRWVASWSQNG

SEQ ID NO: 3387004 - protein, 21 aa, Plasmodium falciparum
KNMFLKNCFLVRNTNVKCWRT

SEQ ID NO: 3387005 - protein, 17 aa, Plasmodium falciparum
KNMFSSVHAKVFNYFKR

SEQ ID NO: 3387006 - protein, 21 aa, Plasmodium falciparum
KNMFYFKCPYCLWSSINTVCK

SEQ ID NO: 3387007 - protein, 26 aa, Plasmodium falciparum
KNMKLENILIFLKALLLEKKIVISCS

SEQ ID NO: 3387008 - protein, 29 aa, Plasmodium falciparum
KNMKTLYHNLFMNKIFYYVIPKSKISCDN

SEQ ID NO: 3387009 - protein, 25 aa, Plasmodium falciparum
KNMLLNLHKDMWTNPLKLNDFHEQK

SEQ ID NO: 3387010 - protein, 24 aa, Plasmodium falciparum
KNMNNWKFSHLKGGNFKSAKFLKW

SEQ ID NO: 3387011 - protein, 29 aa, Plasmodium falciparum
KNMPKVRGVWFNSTPQRMGWVGQAYKKCK

SEQ ID NO: 3387012 - protein, 20 aa, Plasmodium falciparum
KNMQTLYKNLYPWNNVNDEN

SEQ ID NO: 3387013 - protein, 25 aa, Plasmodium falciparum
KNMVDKIINQCLLNSTKKTCSTYKK

SEQ ID NO: 3387014 - protein, 19 aa, Plasmodium falciparum
KNMVPPITIILKEENHTSN

SEQ ID NO: 3387015 - protein, 25 aa, Plasmodium falciparum
KNNDELNNYIKTLKLKYNESYNDIQ

SEQ ID NO: 3387016 - protein, 17 aa, Plasmodium falciparum
KNNDILISKQKIEDLKK

SEQ ID NO: 3387017 - protein, 20 aa, Plasmodium falciparum
KNNDILYFFKNTLTHHIKET

SEQ ID NO: 3387018 - protein, 25 aa, Plasmodium falciparum
KNNDLPLLYNIPFNYTLEELYNKVK

SEQ ID NO: 3387019 - protein, 25 aa, Plasmodium falciparum
KNNENLLFILNIIKNNFQEIKIKAQ

SEQ ID NO: 3387020 - protein, 28 aa, Plasmodium falciparum
KNNILKFLQNKFIYPIKNLIVIYDLINR

SEQ ID NO: 3387021 - protein, 30 aa, Plasmodium falciparum
KNNIPIYHDSIIQFYIYEHVFVSSSDNSLN

SEQ ID NO: 3387022 - protein, 22 aa, Plasmodium falciparum
KNNIPYFNFFVNYFEAVVHMNI

SEQ ID NO: 3387023 - protein, 25 aa, Plasmodium falciparum
KNNKESITLPFRFVSKYYYTKCEQD

SEQ ID NO: 3387024 - protein, 29 aa, Plasmodium falciparum
KNNKISEKLIFLKYLFNEYGHTEYPNLIS

SEQ ID NO: 3387025 - protein, 23 aa, Plasmodium falciparum
KNNKIVILIAYNNYIALMHNDNQ

SEQ ID NO: 3387026 - protein, 23 aa, Plasmodium falciparum
KNNKKFLCDTDTLFYENNVRPVK

SEQ ID NO: 3387027 - protein, 24 aa, Plasmodium falciparum
KNNKLKFLICQMKKLKLYDEQNEN

SEQ ID NO: 3387028 - protein, 28 aa, Plasmodium falciparum
KNNKMKYKIKSNSIPPIIKKIERKSNDN

SEQ ID NO: 3387029 - protein, 29 aa, Plasmodium falciparum
KNNKNILTKLWIFSLNIYQLVVTDIKFHP

SEQ ID NO: 3387030 - protein, 26 aa, Plasmodium falciparum
KNNKNKFTLDKLFIQNKKDKDSYKNS

SEQ ID NO: 3387031 - protein, 28 aa, Plasmodium falciparum
KNNKTLLLPFLHNIFEQMKLINWAGYHV

SEQ ID NO: 3387032 - protein, 31 aa, Plasmodium falciparum
KNNLSNMDYFKITNYERKIINHKNFVHNSNR

SEQ ID NO: 3387033 - protein, 24 aa, Plasmodium falciparum
KNNLSNMENFPPSLSFNNSDINKN

SEQ ID NO: 3387034 - protein, 29 aa, Plasmodium falciparum
KNNNDFIIYMELHLENLVIRRYNFVLGNE

SEQ ID NO: 3387035 - protein, 22 aa, Plasmodium falciparum
KNNNDYYIKYNNLNEFKEEEEK

SEQ ID NO: 3387036 - protein, 25 aa, Plasmodium falciparum
KNNNIDNILLLDKAIRNQSIYYNNN

SEQ ID NO: 3387037 - protein, 57 aa, Plasmodium falciparum
KNNNPFNHNINYIINYPLLDIDNKYMSVLFHMWQKMELNFFFKKYYQNNKYKEIKEK

SEQ ID NO: 3387038 - protein, 27 aa, Plasmodium falciparum
KNNRIHIKKYMNNKYLLNFRDGKKDDI

SEQ ID NO: 3387039 - protein, 21 aa, Plasmodium falciparum
KNNSHLFKIQYDNLNISQDNQ

SEQ ID NO: 3387040 - protein, 23 aa, Plasmodium falciparum
KNNSYIGISILPYNIRGFISDSK

SEQ ID NO: 3387041 - protein, 23 aa, Plasmodium falciparum
KNNTLINKIDKYDKNSLLIKIKD

SEQ ID NO: 3387042 - protein, 24 aa, Plasmodium falciparum
KNNVGDLIVYFINSIDYKINNCII

SEQ ID NO: 3387043 - protein, 23 aa, Plasmodium falciparum
KNNVLHCYTNLSKIPYIYSCRKY

SEQ ID NO: 3387044 - protein, 17 aa, Plasmodium falciparum
KNNVYIFRCGEKTFNDL

SEQ ID NO: 3387045 - protein, 21 aa, Plasmodium falciparum
KNNYDIFTLGDIKKYAKNNEK

SEQ ID NO: 3387046 - protein, 28 aa, Plasmodium falciparum
KNNYEEKFLDDVILDDSIFATSNELLQH

SEQ ID NO: 3387047 - protein, 19 aa, Plasmodium falciparum
KNNYFPSQSILRCDKTKNT

SEQ ID NO: 3387048 - protein, 25 aa, Plasmodium falciparum
KNNYSFQTYLLSPLQFGIPNERLRF

SEQ ID NO: 3387049 - protein, 24 aa, Plasmodium falciparum
KNNYYLYQLYPRRKFCKYQNGSIE

SEQ ID NO: 3387050 - protein, 20 aa, Plasmodium falciparum
KNNYYVINPSLLYIHNNNNN

SEQ ID NO: 3387051 - protein, 23 aa, Plasmodium falciparum
KNPDFPFIIAAVNASFNVIELWD

SEQ ID NO: 3387052 - protein, 29 aa, Plasmodium falciparum
KNPHFYTHKHFIKFINKIKKILKNNKTKN

SEQ ID NO: 3387053 - protein, 21 aa, Plasmodium falciparum
KNPIHFYFNKFNMPSSLLIYG

SEQ ID NO: 3387054 - protein, 24 aa, Plasmodium falciparum
KNPKTYINIRLGKPKKLYITNSSD

SEQ ID NO: 3387055 - protein, 30 aa, Plasmodium falciparum
KNPQKKIFSVFFYYALWANQFDLSWNPTKN

SEQ ID NO: 3387056 - protein, 20 aa, Plasmodium falciparum
KNPRILLLDCTLEYKKAESQ

SEQ ID NO: 3387057 - protein, 25 aa, Plasmodium falciparum
KNPSKYIRYIYNRLLLENSTIRIDG

SEQ ID NO: 3387058 - protein, 20 aa, Plasmodium falciparum
KNPVGVKWRWNMDKAEIIVE

SEQ ID NO: 3387059 - protein, 26 aa, Plasmodium falciparum
KNQIIFKPVFYPYKNVEIINNSFQNY

SEQ ID NO: 3387060 - protein, 35 aa, Plasmodium falciparum
KNQIKRVVDALGVYISLSLLEKTILIQNYGGIDMV

SEQ ID NO: 3387061 - protein, 20 aa, Plasmodium falciparum
KNQILYVKTHLYINQQEHVR

SEQ ID NO: 3387062 - protein, 41 aa, Plasmodium falciparum
KNQNLCSRLFLLQYNGYIWSWSILPVYVNTLNEHRAYHSMI

SEQ ID NO: 3387063 - protein, 24 aa, Plasmodium falciparum
KNQPHNLIQYYNNPFIYGNTNQVI

SEQ ID NO: 3387064 - protein, 30 aa, Plasmodium falciparum
KNRDYNKIFFLFFSIFIYNTQNGGDQKEMH

SEQ ID NO: 3387065 - protein, 52 aa, Plasmodium falciparum
KNREKYFMTVNFTRNKPIAHPFFIYHCLSEKFVKNFVSFVLDPLSEQNYKNF

SEQ ID NO: 3387066 - protein, 24 aa, Plasmodium falciparum
KNRIKIMCIITLDTFYRDVLEVIL

SEQ ID NO: 3387067 - protein, 19 aa, Plasmodium falciparum
KNRLLYDENFENNSDPTYF

SEQ ID NO: 3387068 - protein, 23 aa, Plasmodium falciparum
KNRNFYLHLLNEVNNISIDSSNI

SEQ ID NO: 3387069 - protein, 63 aa, Plasmodium falciparum
KNRNKKIMHPSNITIYLYPTKDYKAHFPNSYMLFRFVNKGIYQVNIPNKCQLNKFPSGQVDCK

SEQ ID NO: 3387070 - protein, 26 aa, Plasmodium falciparum
KNRSNNFDICLYLLQKHGGDLNNEEN

SEQ ID NO: 3387071 - protein, 23 aa, Plasmodium falciparum
KNRSYCDIIWYIDSNSIKDNSFY

SEQ ID NO: 3387072 - protein, 24 aa, Plasmodium falciparum
KNSCNIPIPPPPPKSSSKPISENQ

SEQ ID NO: 3387073 - protein, 25 aa, Plasmodium falciparum
KNSDDFVFLLSTKAGGLGINLTSAD

SEQ ID NO: 3387074 - protein, 29 aa, Plasmodium falciparum
KNSENGFVNLREWTVKVQNRYEKKLKKKV

SEQ ID NO: 3387075 - protein, 18 aa, Plasmodium falciparum
KNSFIRCNIKPLFNLNVC

SEQ ID NO: 3387076 - protein, 25 aa, Plasmodium falciparum
KNSFWKYKKRFFSKKLVNIGILAHI

SEQ ID NO: 3387077 - protein, 24 aa, Plasmodium falciparum
KNSHFIIQQITEASLLYDPLLKID

SEQ ID NO: 3387078 - protein, 23 aa, Plasmodium falciparum
KNSIPKMPILPYYIKKFEQNIQS

SEQ ID NO: 3387079 - protein, 27 aa, Plasmodium falciparum
KNSKLNVKKIYRNMNKWVKKNKKYPFS

SEQ ID NO: 3387080 - protein, 23 aa, Plasmodium falciparum
KNSLPYFMYCKNKPFLMNSKLVQ

SEQ ID NO: 3387081 - protein, 22 aa, Plasmodium falciparum
KNSMNVINGMNIINGLNNMENL

SEQ ID NO: 3387082 - protein, 28 aa, Plasmodium falciparum
KNSNATLIIAFLYKLIQVLKDYFKVLEE

SEQ ID NO: 3387083 - protein, 26 aa, Plasmodium falciparum
KNSNLLKIIPLYFFNENKFSLYVEQL

SEQ ID NO: 3387084 - protein, 25 aa, Plasmodium falciparum
KNSQNVFYILKPIGSITLKDIKHEF

SEQ ID NO: 3387085 - protein, 24 aa, Plasmodium falciparum
KNSSKNAFLINKPLCSSNKRDNES

SEQ ID NO: 3387086 - protein, 23 aa, Plasmodium falciparum
KNSTAHVFIKNGYYLEKQNIKQN

SEQ ID NO: 3387087 - protein, 25 aa, Plasmodium falciparum
KNSTGPIWSLSFHHQGDFFASASMD

SEQ ID NO: 3387088 - protein, 45 aa, Plasmodium falciparum
KNSTNVIRPLKKLFKCEYFEMECIKLIIHIFDKIISKMKKEINME

SEQ ID NO: 3387089 - protein, 24 aa, Plasmodium falciparum
KNSYYAQEFYPFLNPLLNNKDLIG

SEQ ID NO: 3387090 - protein, 57 aa, Plasmodium falciparum
KNTENKKFRILCFQKGSGRLFLNTDIFDGFKIIPSKNLSALFSGRDICDEKKLNQYI

SEQ ID NO: 3387091 - protein, 17 aa, Plasmodium falciparum
KNTFDFFKDLIISNNQD

SEQ ID NO: 3387092 - protein, 18 aa, Plasmodium falciparum
KNTFEDICLLPRDILNDE

SEQ ID NO: 3387093 - protein, 24 aa, Plasmodium falciparum
KNTHISKLFTFLSKKRKNNNNNNT

SEQ ID NO: 3387094 - protein, 38 aa, Plasmodium falciparum
KNTHTYIYGLLIFKHYKYILPYKHIIKDKLKNMKHNFY

SEQ ID NO: 3387095 - protein, 29 aa, Plasmodium falciparum
KNTILFMKELSLTFPHIFYEPRLDNSIEY

SEQ ID NO: 3387096 - protein, 18 aa, Plasmodium falciparum
KNTLYFKKPTCIQKMCIP

SEQ ID NO: 3387097 - protein, 23 aa, Plasmodium falciparum
KNVELAILGRDSLSLSLPEEVKG

SEQ ID NO: 3387098 - protein, 24 aa, Plasmodium falciparum
KNVENLVFFLIYGNNKKYTSTFNR

SEQ ID NO: 3387099 - protein, 19 aa, Plasmodium falciparum
KNVIIQNKMYDLLKKLKNK

SEQ ID NO: 3387100 - protein, 24 aa, Plasmodium falciparum
KNVKDFFYYIDTYEIKKKKLKYSA

SEQ ID NO: 3387101 - protein, 34 aa, Plasmodium falciparum
KNVKLLFNFVYRNYYFNKILRKSIKNFINLYVQY

SEQ ID NO: 3387102 - protein, 25 aa, Plasmodium falciparum
KNVKNGHTLLLYNKIRNNLVLKKYV

SEQ ID NO: 3387103 - protein, 28 aa, Plasmodium falciparum
KNVKSGSPFFLPSFMDCSIHNDDDSGSA

SEQ ID NO: 3387104 - protein, 24 aa, Plasmodium falciparum
KNVKYLYKLYKIFDKLLPKKLVLE

SEQ ID NO: 3387105 - protein, 28 aa, Plasmodium falciparum
KNVKYNFKKSHSSLFNVNLKLGNLTYSD

SEQ ID NO: 3387106 - protein, 20 aa, Plasmodium falciparum
KNVLIPYIKKYMCNSYHIGY

SEQ ID NO: 3387107 - protein, 23 aa, Plasmodium falciparum
KNVLTKIYLLFDDDTYNIAVDIS

SEQ ID NO: 3387108 - protein, 17 aa, Plasmodium falciparum
KNVMLLSLIYENLLINT

SEQ ID NO: 3387109 - protein, 24 aa, Plasmodium falciparum
KNVNKIMMILYEFIKTIPPSYTYY

SEQ ID NO: 3387110 - protein, 28 aa, Plasmodium falciparum
KNVPKKYFIFLLLLSPFFYDDKVECLLY

SEQ ID NO: 3387111 - protein, 19 aa, Plasmodium falciparum
KNWDALYEALEPFGKTKDQ

SEQ ID NO: 3387112 - protein, 38 aa, Plasmodium falciparum
KNWKLNFPDINTENLFFHLYFLSELYKEKRYICQNCGS

SEQ ID NO: 3387113 - protein, 17 aa, Plasmodium falciparum
KNYAYVIKIINLKIILT

SEQ ID NO: 3387114 - protein, 21 aa, Plasmodium falciparum
KNYIHDHMPIIPLSINRKEKI

SEQ ID NO: 3387115 - protein, 21 aa, Plasmodium falciparum
KNYIKISALIILESYYKDVAE

SEQ ID NO: 3387116 - protein, 22 aa, Plasmodium falciparum
KNYIYPFDFSFLNTKITFDFLQ

SEQ ID NO: 3387117 - protein, 21 aa, Plasmodium falciparum
KNYKRILLIEKYTKYDNLKKL

SEQ ID NO: 3387118 - protein, 21 aa, Plasmodium falciparum
KNYLHIFDYFIPLTNEKLDRH

SEQ ID NO: 3387119 - protein, 20 aa, Plasmodium falciparum
KNYMDTFTKITLTNESNKNI

SEQ ID NO: 3387120 - protein, 34 aa, Plasmodium falciparum
KNYNSILSTYYIPFDILNTFYKYYLSNKLLSHDK

SEQ ID NO: 3387121 - protein, 24 aa, Plasmodium falciparum
KNYSLISRINLLNYETNVLKQLIK

SEQ ID NO: 3387122 - protein, 40 aa, Plasmodium falciparum
KNYTHYLNEHWMNRKILGGYIIFPCKLIHEKEDMEQSKTN

SEQ ID NO: 3387123 - protein, 28 aa, Plasmodium falciparum
KNYVLNLLKPIDFSNIIFISAKTSQRLL

SEQ ID NO: 3387124 - protein, 25 aa, Plasmodium falciparum
KPDDMYINSYIPYPPEKYNNIYDLH

SEQ ID NO: 3387125 - protein, 17 aa, Plasmodium falciparum
KPDFILCTFGGQTALNC

SEQ ID NO: 3387126 - protein, 25 aa, Plasmodium falciparum
KPDIRRIIHYGFARSLEAYVQQVGR

SEQ ID NO: 3387127 - protein, 36 aa, Plasmodium falciparum
KPDNIYLYIYNNIYSFLLNKIFIMGPPVLKITSMLS

SEQ ID NO: 3387128 - protein, 20 aa, Plasmodium falciparum
KPDVVFYLNVPPNYAQNRSD

SEQ ID NO: 3387129 - protein, 19 aa, Plasmodium falciparum
KPEERWRPIWSVEGILVSV

SEQ ID NO: 3387130 - protein, 26 aa, Plasmodium falciparum
KPEIWKKMISGSLYPLKKGFVAVVCR

SEQ ID NO: 3387131 - protein, 23 aa, Plasmodium falciparum
KPENILLDDPYFEKSLITVRRVT

SEQ ID NO: 3387132 - protein, 19 aa, Plasmodium falciparum
KPFFIVEHPQIMSPLAKYH

SEQ ID NO: 3387133 - protein, 18 aa, Plasmodium falciparum
KPFHYKIHKYNEKVYIIK

SEQ ID NO: 3387134 - protein, 21 aa, Plasmodium falciparum
KPFLLCINKNVLKKNILLEEE

SEQ ID NO: 3387135 - protein, 17 aa, Plasmodium falciparum
KPFNFVLKKDKVNLPLL

SEQ ID NO: 3387136 - protein, 20 aa, Plasmodium falciparum
KPFNNMTFSLNKYLNPYVNY

SEQ ID NO: 3387137 - protein, 20 aa, Plasmodium falciparum
KPGFKLIRGNHEILTLIDAR

SEQ ID NO: 3387138 - protein, 17 aa, Plasmodium falciparum
KPGILPCILKSLVEKRS

SEQ ID NO: 3387139 - protein, 18 aa, Plasmodium falciparum
KPIFLKNCKDKTSDNKFN

SEQ ID NO: 3387140 - protein, 41 aa, Plasmodium falciparum
KPIKMVINKHINYLKDKLYLLNILLKFYIQKIKNIMEQNIN

SEQ ID NO: 3387141 - protein, 30 aa, Plasmodium falciparum
KPKDNIFGSTSLFGSSIFKASPSKDNVTSN

SEQ ID NO: 3387142 - protein, 18 aa, Plasmodium falciparum
KPKFLRVGILSNQLIFKT

SEQ ID NO: 3387143 - protein, 19 aa, Plasmodium falciparum
KPKHYVYLFQSCSRLKWND

SEQ ID NO: 3387144 - protein, 24 aa, Plasmodium falciparum
KPKIMSFLSLRKFISFLNNIYSIN

SEQ ID NO: 3387145 - protein, 18 aa, Plasmodium falciparum
KPKYRFEKDKDGNICDFF

SEQ ID NO: 3387146 - protein, 33 aa, Plasmodium falciparum
KPKYVEIPVPIYVPCYIEVPIPAQYIPIEQNDD

SEQ ID NO: 3387147 - protein, 30 aa, Plasmodium falciparum
KPLDLISTYSIFMYILRSHFFKHIPQSSYV

SEQ ID NO: 3387148 - protein, 25 aa, Plasmodium falciparum
KPLIENEYIFYKKLTNFGSSSTESG

SEQ ID NO: 3387149 - protein, 20 aa, Plasmodium falciparum
KPLVPLRRIPKNRGTVVRNV

SEQ ID NO: 3387150 - protein, 27 aa, Plasmodium falciparum
KPNDSYIFITPYALLLTINNFNSQYYL

SEQ ID NO: 3387151 - protein, 38 aa, Plasmodium falciparum
KPNNCLWVGNILKNYFFNTANILKTMFSYFGEIRNIKY

SEQ ID NO: 3387152 - protein, 32 aa, Plasmodium falciparum
KPNVIHYNILQIRKKRLYLSFPYHSHSEKKND

SEQ ID NO: 3387153 - protein, 20 aa, Plasmodium falciparum
KPQKRIVVNKKLEDFVKHKK

SEQ ID NO: 3387154 - protein, 32 aa, Plasmodium falciparum
KPQRGVYFDKSQKAWIGSWYEEGKQIKRRFKI

SEQ ID NO: 3387155 - protein, 17 aa, Plasmodium falciparum
KPRALWTGKQIFSMLLQ

SEQ ID NO: 3387156 - protein, 20 aa, Plasmodium falciparum
KPRCLVISDYKNNLLRYFSN

SEQ ID NO: 3387157 - protein, 19 aa, Plasmodium falciparum
KPRKLLLTNLYPWAYKTAI

SEQ ID NO: 3387158 - protein, 24 aa, Plasmodium falciparum
KPRMSKRLSEKKKLLLNMEGKEKN

SEQ ID NO: 3387159 - protein, 21 aa, Plasmodium falciparum
KPSLFIHTILKELINNDNNNN

SEQ ID NO: 3387160 - protein, 32 aa, Plasmodium falciparum
KPSYEETKLYPLKIICNKNLGNFLIKKEKILV

SEQ ID NO: 3387161 - protein, 18 aa, Plasmodium falciparum
KPTFYARIGKRMFTGNEE

SEQ ID NO: 3387162 - protein, 26 aa, Plasmodium falciparum
KPTMLQPLSSFNLRQNERKYEQSDFI

SEQ ID NO: 3387163 - protein, 19 aa, Plasmodium falciparum
KPTNILRYDNKRIVIADFG

SEQ ID NO: 3387164 - protein, 46 aa, Plasmodium falciparum
KPVSYLNTKFQIRLSLLLKLQTETLFYIFYNLPRDVLQAYAASELY

SEQ ID NO: 3387165 - protein, 28 aa, Plasmodium falciparum
KPYLVDVCVNKYFKKYKIKFSQTCLSCF

SEQ ID NO: 3387166 - protein, 26 aa, Plasmodium falciparum
KPYPLNTLQMTKLVSIYFKISSKECM

SEQ ID NO: 3387167 - protein, 23 aa, Plasmodium falciparum
KQADDFIFYKNELMLDKSISDYE

SEQ ID NO: 3387168 - protein, 23 aa, Plasmodium falciparum
KQARDNLDRTLTPLAICDIKNKT

SEQ ID NO: 3387169 - protein, 17 aa, Plasmodium falciparum
KQCLNKYERQLIKFVQT

SEQ ID NO: 3387170 - protein, 24 aa, Plasmodium falciparum
KQCNDILNIYKWSVNFTNLNKELL

SEQ ID NO: 3387171 - protein, 21 aa, Plasmodium falciparum
KQCTKLYYINKDILNYIFSDT

SEQ ID NO: 3387172 - protein, 19 aa, Plasmodium falciparum
KQDKNIKLLKLIEKSNKDD

SEQ ID NO: 3387173 - protein, 27 aa, Plasmodium falciparum
KQDKNYILKVLKFLKKVNIIQKLDNDT

SEQ ID NO: 3387174 - protein, 25 aa, Plasmodium falciparum
KQDMSNLRNFDLNELRKKHLNNYHK

SEQ ID NO: 3387175 - protein, 32 aa, Plasmodium falciparum
KQECLKYDMYELLLLRFLKYECDYDDSEDILN

SEQ ID NO: 3387176 - protein, 22 aa, Plasmodium falciparum
KQEKYIIQLQKDNNLILNDFNS

SEQ ID NO: 3387177 - protein, 26 aa, Plasmodium falciparum
KQEPKSEIQTIPKKAIVTAVKTNNVS

SEQ ID NO: 3387178 - protein, 28 aa, Plasmodium falciparum
KQEQIYKIYSRLQNRILNDFKKGCLKKM

SEQ ID NO: 3387179 - protein, 27 aa, Plasmodium falciparum
KQEQLIHIDNQLKKKIFTIKNSKNNNM

SEQ ID NO: 3387180 - protein, 20 aa, Plasmodium falciparum
KQESLDPLLKCINSLSDRIN

SEQ ID NO: 3387181 - protein, 21 aa, Plasmodium falciparum
KQEYAHMMLSDKNIYVEFENF

SEQ ID NO: 3387182 - protein, 18 aa, Plasmodium falciparum
KQFLEYMNNLPYLKDHNK

SEQ ID NO: 3387183 - protein, 33 aa, Plasmodium falciparum
KQFLKALKIKVYYIIILFKLNDNFIFNKLIGIY

SEQ ID NO: 3387184 - protein, 35 aa, Plasmodium falciparum
KQFLKLNDIPLFIYSFNLFIKCNLIKSLTLVCDKK

SEQ ID NO: 3387185 - protein, 26 aa, Plasmodium falciparum
KQFLNNLFDTFLEKNLNYVINSKDVN

SEQ ID NO: 3387186 - protein, 26 aa, Plasmodium falciparum
KQGDIIICTAGRLLDLLNSCKVSLSF

SEQ ID NO: 3387187 - protein, 27 aa, Plasmodium falciparum
KQICESVFHCIKLIEVLQLEELKDICV

SEQ ID NO: 3387188 - protein, 20 aa, Plasmodium falciparum
KQIDEGLKYLKKYSSVIVSN

SEQ ID NO: 3387189 - protein, 18 aa, Plasmodium falciparum
KQIILNGDIVIETKKEEE

SEQ ID NO: 3387190 - protein, 18 aa, Plasmodium falciparum
KQIINCYYDEKDELKPKA

SEQ ID NO: 3387191 - protein, 27 aa, Plasmodium falciparum
KQINIKFLQLYKKLLQYIYENIKYMDS

SEQ ID NO: 3387192 - protein, 27 aa, Plasmodium falciparum
KQINISKYAIWFCLEKTYCFEINDCIR

SEQ ID NO: 3387193 - protein, 18 aa, Plasmodium falciparum
KQINNPLSHLNLNDFSNI

SEQ ID NO: 3387194 - protein, 21 aa, Plasmodium falciparum
KQIQTLIDTFKKYIQDHSFIL

SEQ ID NO: 3387195 - protein, 18 aa, Plasmodium falciparum
KQKAEHILKVQKAILKSQ

SEQ ID NO: 3387196 - protein, 17 aa, Plasmodium falciparum
KQKGCVDYIFYSYKNLK

SEQ ID NO: 3387197 - protein, 23 aa, Plasmodium falciparum
KQKKSYLENIPGGRIKKLNKQIN

SEQ ID NO: 3387198 - protein, 25 aa, Plasmodium falciparum
KQKNITSVYVCGFIFEYCVKETALS

SEQ ID NO: 3387199 - protein, 38 aa, Plasmodium falciparum
KQKNLNSCLSLKLKSIHIKLNNLFLKKNEFEKTINNKI

SEQ ID NO: 3387200 - protein, 24 aa, Plasmodium falciparum
KQKNRRRYEYMKKLDMRKRQNNLD

SEQ ID NO: 3387201 - protein, 32 aa, Plasmodium falciparum
KQKSISYYKYISKSLSYVFNLAQPLVTTNTTF

SEQ ID NO: 3387202 - protein, 23 aa, Plasmodium falciparum
KQKYLEVLENIRKLLQCKENIDD

SEQ ID NO: 3387203 - protein, 30 aa, Plasmodium falciparum
KQLEKELDVYLKIEGFLLSSSAKSSISLPS

SEQ ID NO: 3387204 - protein, 17 aa, Plasmodium falciparum
KQLELRLIQKILKAMEK

SEQ ID NO: 3387205 - protein, 21 aa, Plasmodium falciparum
KQLGDLLEKCLILDPSKRYTP

SEQ ID NO: 3387206 - protein, 32 aa, Plasmodium falciparum
KQLKIYKAREKKWINLVKLLILELKNSSKTNQ

SEQ ID NO: 3387207 - protein, 23 aa, Plasmodium falciparum
KQLKRNLLISLCEKYNINILYSN

SEQ ID NO: 3387208 - protein, 36 aa, Plasmodium falciparum
KQLQNKIVMLKKLCLRILFINEYQIYNIKKLQENIN

SEQ ID NO: 3387209 - protein, 30 aa, Plasmodium falciparum
KQLRIFYNFYHILKFIIFKVNNFSISDFTQ

SEQ ID NO: 3387210 - protein, 24 aa, Plasmodium falciparum
KQMELFVMAYLSFDEQLLKLLNYS

SEQ ID NO: 3387211 - protein, 20 aa, Plasmodium falciparum
KQMELKLLFERIDEAIKIND

SEQ ID NO: 3387212 - protein, 18 aa, Plasmodium falciparum
KQMLLNEVDRIKEKKKKE

SEQ ID NO: 3387213 - protein, 23 aa, Plasmodium falciparum
KQMNTFVPKYNNLTPKEIHYNSL

SEQ ID NO: 3387214 - protein, 27 aa, Plasmodium falciparum
KQMRPKCIFNWKIAKKSLMKMLHSAHN

SEQ ID NO: 3387215 - protein, 23 aa, Plasmodium falciparum
KQNAFCPLRKSINKDIPFFINYD

SEQ ID NO: 3387216 - protein, 56 aa, Plasmodium falciparum
KQNEKLIYTNYEIKMFLLNTIKAIGIVFKKWKFKNFGLYFWYHIKCIENERDLNFY

SEQ ID NO: 3387217 - protein, 27 aa, Plasmodium falciparum
KQNENEYFLFIKWATIKNSFIYSSYSS

SEQ ID NO: 3387218 - protein, 23 aa, Plasmodium falciparum
KQNFFQNCDMSENIWLNKKFDEH

SEQ ID NO: 3387219 - protein, 24 aa, Plasmodium falciparum
KQNIDVLLLLEEIDEFVLMNLQTY

SEQ ID NO: 3387220 - protein, 23 aa, Plasmodium falciparum
KQNIVQPLIPYYYKNLPSIKVYQ

SEQ ID NO: 3387221 - protein, 23 aa, Plasmodium falciparum
KQNKEKYMHISLKKKIVAQDEGE

SEQ ID NO: 3387222 - protein, 28 aa, Plasmodium falciparum
KQNKEQIFYFLLFYPFELKQTVIHIKNN

SEQ ID NO: 3387223 - protein, 34 aa, Plasmodium falciparum
KQNKTTQYFKNMKILFTFLNIYAKQNSLDIDDFF

SEQ ID NO: 3387224 - protein, 26 aa, Plasmodium falciparum
KQNLLYTLFDLLHKKNIYINIICLTN

SEQ ID NO: 3387225 - protein, 21 aa, Plasmodium falciparum
KQQNVILSNIKIALNKRNDLD

SEQ ID NO: 3387226 - protein, 19 aa, Plasmodium falciparum
KQQYRSFKLNQLQAKQQKI

SEQ ID NO: 3387227 - protein, 35 aa, Plasmodium falciparum
KQRITFLENELFKSFLFTYPVYYMNARQKNKSLLN

SEQ ID NO: 3387228 - protein, 25 aa, Plasmodium falciparum
KQRNCPFVIALNKIDRLYMWNKNDW

SEQ ID NO: 3387229 - protein, 24 aa, Plasmodium falciparum
KQRTYDDVVILQLAAHKNGCVISN

SEQ ID NO: 3387230 - protein, 26 aa, Plasmodium falciparum
KQSSVQYFVPINLRLKNKLNDVCETK

SEQ ID NO: 3387231 - protein, 25 aa, Plasmodium falciparum
KQTDIYFLCMNCIKNNIFNVTHHME

SEQ ID NO: 3387232 - protein, 20 aa, Plasmodium falciparum
KQTFQYLFENKLITIPYEQE

SEQ ID NO: 3387233 - protein, 46 aa, Plasmodium falciparum
KQTSTLFNKMLIGLGYILKNFFPLYKFKVLGRTLKYPWVKLDDDTD

SEQ ID NO: 3387234 - protein, 19 aa, Plasmodium falciparum
KQTYKDVLLKNIKMKVKQT

SEQ ID NO: 3387235 - protein, 24 aa, Plasmodium falciparum
KQVIDLIFNCLHPNFNIRYNINEA

SEQ ID NO: 3387236 - protein, 31 aa, Plasmodium falciparum
KQYEELKKFISAYLIYLLQNGNIDDEKMNVD

SEQ ID NO: 3387237 - protein, 21 aa, Plasmodium falciparum
KQYFFNCIQMAKLDISKSSAT

SEQ ID NO: 3387238 - protein, 33 aa, Plasmodium falciparum
KQYIQQFDWPEELFKLQYFNIDMFLTMCVLSGC

SEQ ID NO: 3387239 - protein, 35 aa, Plasmodium falciparum
KQYKSVFCVWLLTFKDYFIKQLYKNNIIAIVINLF

SEQ ID NO: 3387240 - protein, 37 aa, Plasmodium falciparum
KQYNKYISLFQLMQSKPYILDPLIYDSKKILDKFIPI

SEQ ID NO: 3387241 - protein, 18 aa, Plasmodium falciparum
KRCAYDFGMKIIGKPRSR

SEQ ID NO: 3387242 - protein, 32 aa, Plasmodium falciparum
KRCIFHYVNGFKLYGWLNYKWTDPDGFLELSI

SEQ ID NO: 3387243 - protein, 29 aa, Plasmodium falciparum
KRDFGPIYILFEIPMFNLSKLRIKYLRII

SEQ ID NO: 3387244 - protein, 19 aa, Plasmodium falciparum
KRDIFKIHKWSAVAAWSWD

SEQ ID NO: 3387245 - protein, 20 aa, Plasmodium falciparum
KRDIIYKVKDLSCKLSELYN

SEQ ID NO: 3387246 - protein, 35 aa, Plasmodium falciparum
KRDIYRSYYNFSCKFLLLHFLLKNIKQNTNDKVVI

SEQ ID NO: 3387247 - protein, 34 aa, Plasmodium falciparum
KRDRKVFMGKYFFSDIINTIIYPCTNKSLQKYQY

SEQ ID NO: 3387248 - protein, 22 aa, Plasmodium falciparum
KRDSIIEILYNKLKEKENDITL

SEQ ID NO: 3387249 - protein, 26 aa, Plasmodium falciparum
KRDTCIHPLLLLNEDLFLLKDFNISE

SEQ ID NO: 3387250 - protein, 23 aa, Plasmodium falciparum
KRDTLLEELKNLIKKRKYEYELL

SEQ ID NO: 3387251 - protein, 25 aa, Plasmodium falciparum
KREENIFIPLKILSNKYDFNDLVEA

SEQ ID NO: 3387252 - protein, 21 aa, Plasmodium falciparum
KREKIDDIIAIVEKEESIKQK

SEQ ID NO: 3387253 - protein, 24 aa, Plasmodium falciparum
KRELNQIYVIKWSNLNKLKNVDDE

SEQ ID NO: 3387254 - protein, 21 aa, Plasmodium falciparum
KREMHSDIFFSSYPSKSKDNI

SEQ ID NO: 3387255 - protein, 20 aa, Plasmodium falciparum
KREQIILKSIKYNKKYNEDQ

SEQ ID NO: 3387256 - protein, 40 aa, Plasmodium falciparum
KREVIDKKPYIFKIAALRDIRNLFPLNHNPFYAAFGNTES

SEQ ID NO: 3387257 - protein, 19 aa, Plasmodium falciparum
KRFEKLYDIFYFNTDDNLK

SEQ ID NO: 3387258 - protein, 28 aa, Plasmodium falciparum
KRFGAIKDVYLPIDYYTKEPRGFGFVEF

SEQ ID NO: 3387259 - protein, 22 aa, Plasmodium falciparum
KRFIYWPPKNKLRTLRFPSGKK

SEQ ID NO: 3387260 - protein, 25 aa, Plasmodium falciparum
KRFLPRSCQILLFSATYNDSVRKFA

SEQ ID NO: 3387261 - protein, 26 aa, Plasmodium falciparum
KRFLRRSFNRSYYYKKNEKEKIEEMN

SEQ ID NO: 3387262 - protein, 19 aa, Plasmodium falciparum
KRFRKRDINLERHKERGYI

SEQ ID NO: 3387263 - protein, 25 aa, Plasmodium falciparum
KRGDHLKIHLLGHKISEEKNKYQCP

SEQ ID NO: 3387264 - protein, 20 aa, Plasmodium falciparum
KRGHILRKTCSLNVIGGFLK

SEQ ID NO: 3387265 - protein, 32 aa, Plasmodium falciparum
KRGIDIKQKFRLLYSFGPQIRYLHSDEYLVEI

SEQ ID NO: 3387266 - protein, 19 aa, Plasmodium falciparum
KRGKFLCSASYERFIIILN

SEQ ID NO: 3387267 - protein, 28 aa, Plasmodium falciparum
KRGNIISTMFFPRSPYFMVAFENNITIY

SEQ ID NO: 3387268 - protein, 27 aa, Plasmodium falciparum
KRGVLPIIGILYIILNGNLGYNGSSSS

SEQ ID NO: 3387269 - protein, 21 aa, Plasmodium falciparum
KRHIVTFKGIYSFLNYMADIL

SEQ ID NO: 3387270 - protein, 45 aa, Plasmodium falciparum
KRHKKIYFSSCLFLIKFLEHVENLKYLFFFYSSIVQTNYSHANNY

SEQ ID NO: 3387271 - protein, 26 aa, Plasmodium falciparum
KRIDTSTLLFILENYADLKKWFVHIP

SEQ ID NO: 3387272 - protein, 49 aa, Plasmodium falciparum
KRIFLNGSVIKISFAPNGFFCLILTSRTLYLCNFFYFSIYEITNNCYNS

SEQ ID NO: 3387273 - protein, 39 aa, Plasmodium falciparum
KRIGIITPYATEKFFLKKILKRFFISKGYSKNISNFIDV

SEQ ID NO: 3387274 - protein, 20 aa, Plasmodium falciparum
KRIIFPIQLSNIYSNFVCIH

SEQ ID NO: 3387275 - protein, 25 aa, Plasmodium falciparum
KRIKKIFEFAQIFKKMSQKKKENKK

SEQ ID NO: 3387276 - protein, 25 aa, Plasmodium falciparum
KRIKSPIDVQLIAQLRQLYAPDSIE

SEQ ID NO: 3387277 - protein, 22 aa, Plasmodium falciparum
KRILEKKYKINLLNHFCAKTEK

SEQ ID NO: 3387278 - protein, 19 aa, Plasmodium falciparum
KRILFVKEINEIKKIIQKE

SEQ ID NO: 3387279 - protein, 25 aa, Plasmodium falciparum
KRILNLIHFFFHKGGKRFYHSNIHF

SEQ ID NO: 3387280 - protein, 44 aa, Plasmodium falciparum
KRILNSYIQNLFIRPDIRCCAIFLNFLLFYDKINLSIDIVKTKL

SEQ ID NO: 3387281 - protein, 25 aa, Plasmodium falciparum
KRINDNFFKLHSNLASNLLSTSTSG

SEQ ID NO: 3387282 - protein, 18 aa, Plasmodium falciparum
KRINILLVTGRLIYYERC

SEQ ID NO: 3387283 - protein, 29 aa, Plasmodium falciparum
KRINSKIDKKYIIKCRACKFINPNGFKIE

SEQ ID NO: 3387284 - protein, 18 aa, Plasmodium falciparum
KRIPKKKKKKRNLINSSN

SEQ ID NO: 3387285 - protein, 22 aa, Plasmodium falciparum
KRIQAIRLIKYISLKVISIDEK

SEQ ID NO: 3387286 - protein, 30 aa, Plasmodium falciparum
KRIQEDLVFIPWRDSKLTRILSKSLGGNCR

SEQ ID NO: 3387287 - protein, 20 aa, Plasmodium falciparum
KRKAINVYQYILEEGGRVDR

SEQ ID NO: 3387288 - protein, 20 aa, Plasmodium falciparum
KRKEEILKEYLKITVDKVVL

SEQ ID NO: 3387289 - protein, 22 aa, Plasmodium falciparum
KRKEFYIYYTKDDIKLAYDIIR

SEQ ID NO: 3387290 - protein, 20 aa, Plasmodium falciparum
KRKFIHVRSIIEQKGGRRKC

SEQ ID NO: 3387291 - protein, 22 aa, Plasmodium falciparum
KRKKDKFLSKKEKKRKAMSEEE

SEQ ID NO: 3387292 - protein, 28 aa, Plasmodium falciparum
KRKKKKVVFFSFLKKGKSIYHINSLNIN

SEQ ID NO: 3387293 - protein, 28 aa, Plasmodium falciparum
KRKKLGRPLLRMFWNNSQNSLPHYSVFR

SEQ ID NO: 3387294 - protein, 25 aa, Plasmodium falciparum
KRKNEILWPIFQINHKTSRYIYELY

SEQ ID NO: 3387295 - protein, 17 aa, Plasmodium falciparum
KRKNIYCINFKKYYKSL

SEQ ID NO: 3387296 - protein, 26 aa, Plasmodium falciparum
KRKNKALLDIILLKKELRELKKKNKQ

SEQ ID NO: 3387297 - protein, 20 aa, Plasmodium falciparum
KRKNLLLSKKLNGLVENMKN

SEQ ID NO: 3387298 - protein, 24 aa, Plasmodium falciparum
KRKNTFLNFLINLDDLNKHHRQTN

SEQ ID NO: 3387299 - protein, 21 aa, Plasmodium falciparum
KRKQFYFDVSNADKFMLGVFF

SEQ ID NO: 3387300 - protein, 26 aa, Plasmodium falciparum
KRKSISNLPLYIPKVQETKKCNNSFH

SEQ ID NO: 3387301 - protein, 26 aa, Plasmodium falciparum
KRKVQILRVLNKYYFEKEYNDYILNR

SEQ ID NO: 3387302 - protein, 31 aa, Plasmodium falciparum
KRLAIEWKKARIRGEVWDRFINKKKKNTNNN

SEQ ID NO: 3387303 - protein, 27 aa, Plasmodium falciparum
KRLDAPFIDTAYNLALAKYPPNPSLYE

SEQ ID NO: 3387304 - protein, 20 aa, Plasmodium falciparum
KRLDHALSKYKKYSTTSIST

SEQ ID NO: 3387305 - protein, 37 aa, Plasmodium falciparum
KRLELAGQLISLLFEDLYKRFYFTLKKQIDQTLSKYM

SEQ ID NO: 3387306 - protein, 18 aa, Plasmodium falciparum
KRLETYLIMNKLYNQNKK

SEQ ID NO: 3387307 - protein, 25 aa, Plasmodium falciparum
KRLGKTIHMIGLLKKGYNYVKCLKN

SEQ ID NO: 3387308 - protein, 18 aa, Plasmodium falciparum
KRLSITPSILPLKNKKKY

SEQ ID NO: 3387309 - protein, 19 aa, Plasmodium falciparum
KRMKNYLTLYIPGTDHAGI

SEQ ID NO: 3387310 - protein, 25 aa, Plasmodium falciparum
KRNCTLIVYNLPPQVTWKELKDLFR

SEQ ID NO: 3387311 - protein, 24 aa, Plasmodium falciparum
KRNDKILCFNTVKFIAHMINQRIV

SEQ ID NO: 3387312 - protein, 25 aa, Plasmodium falciparum
KRNDTIFGKSLLSLNIYNPYNNNNN

SEQ ID NO: 3387313 - protein, 20 aa, Plasmodium falciparum
KRNIIFPSCYMKCDKAKIVI

SEQ ID NO: 3387314 - protein, 20 aa, Plasmodium falciparum
KRNILYKEQFNIIVKNYKDC

SEQ ID NO: 3387315 - protein, 21 aa, Plasmodium falciparum
KRNKKTDDIFLFCIETKKNDN

SEQ ID NO: 3387316 - protein, 18 aa, Plasmodium falciparum
KRNLLRNGLCSDFFFFFF

SEQ ID NO: 3387317 - protein, 22 aa, Plasmodium falciparum
KRNNFFNMTAYIYGSSNILANT

SEQ ID NO: 3387318 - protein, 24 aa, Plasmodium falciparum
KRNNFNVLFYIYNMYHNNFSYFSQ

SEQ ID NO: 3387319 - protein, 23 aa, Plasmodium falciparum
KRNNNIIMPINDLKTYINDEWSN

SEQ ID NO: 3387320 - protein, 17 aa, Plasmodium falciparum
KRNSPPTSYKTIIDRER

SEQ ID NO: 3387321 - protein, 18 aa, Plasmodium falciparum
KRNTITERRYLGNKNNNI

SEQ ID NO: 3387322 - protein, 25 aa, Plasmodium falciparum
KRNTNKLFTCKELFPKNKEYFILNK

SEQ ID NO: 3387323 - protein, 24 aa, Plasmodium falciparum
KRNYASIFAQVKTPRRNASNNKKK

SEQ ID NO: 3387324 - protein, 20 aa, Plasmodium falciparum
KRPNFAPIFLDQLKPRMVLY

SEQ ID NO: 3387325 - protein, 26 aa, Plasmodium falciparum
KRPRRCGWLDIPMLLYVKCINSIDMI

SEQ ID NO: 3387326 - protein, 41 aa, Plasmodium falciparum
KRQSVLCKVLFNYIQKTCGVCLIFCFNPKISQKSLTSSTLI

SEQ ID NO: 3387327 - protein, 20 aa, Plasmodium falciparum
KRRKINILNIFDNNIKKKNE

SEQ ID NO: 3387328 - protein, 22 aa, Plasmodium falciparum
KRRNTFNLFNLDEGTINMDLFN

SEQ ID NO: 3387329 - protein, 24 aa, Plasmodium falciparum
KRRRKTWKRLIDKISFVGNDFTRK

SEQ ID NO: 3387330 - protein, 23 aa, Plasmodium falciparum
KRSCFFMLNEKEKCTLKRKVTTT

SEQ ID NO: 3387331 - protein, 27 aa, Plasmodium falciparum
KRSCSQPISHLLPRTIMPLVNTNSGSC

SEQ ID NO: 3387332 - protein, 39 aa, Plasmodium falciparum
KRSDEIIVNILLIFIKKYYYKQWMFYEHIKRLCDYTEIN

SEQ ID NO: 3387333 - protein, 21 aa, Plasmodium falciparum
KRSDNINIDLFFSSDNSVELS

SEQ ID NO: 3387334 - protein, 30 aa, Plasmodium falciparum
KRSENYKLKLIKLTLEKTFLKLDEEMLLSE

SEQ ID NO: 3387335 - protein, 25 aa, Plasmodium falciparum
KRSIRKLLHFFYKQVHPDLTSTLPE

SEQ ID NO: 3387336 - protein, 17 aa, Plasmodium falciparum
KRTITPNTILSISNEKK

SEQ ID NO: 3387337 - protein, 25 aa, Plasmodium falciparum
KRTKSNLSTFRRLFNLKRKKKDKEE

SEQ ID NO: 3387338 - protein, 19 aa, Plasmodium falciparum
KRTLLRDYIKNNDKMYTKD

SEQ ID NO: 3387339 - protein, 17 aa, Plasmodium falciparum
KRVVCAAFYSEEHFLKG

SEQ ID NO: 3387340 - protein, 26 aa, Plasmodium falciparum
KRVYSLYDLYHKLINDCDYSEFLEQN

SEQ ID NO: 3387341 - protein, 24 aa, Plasmodium falciparum
KRWLLQIIMAIKFIHDKKLIHRDL

SEQ ID NO: 3387342 - protein, 23 aa, Plasmodium falciparum
KRYAILIYKYLCKNGIMYRKYNF

SEQ ID NO: 3387343 - protein, 27 aa, Plasmodium falciparum
KRYGHSLDFLYPHLVLFGGNEEICDED

SEQ ID NO: 3387344 - protein, 22 aa, Plasmodium falciparum
KRYLKIALCFNNFKIKIIDIIL

SEQ ID NO: 3387345 - protein, 18 aa, Plasmodium falciparum
KRYRHSCVLINDYMFIIG

SEQ ID NO: 3387346 - protein, 26 aa, Plasmodium falciparum
KRYVRNFVCILNAQCNSRLRIIKDNE

SEQ ID NO: 3387347 - protein, 24 aa, Plasmodium falciparum
KSACKLFFILFEATVKIRGVDELI

SEQ ID NO: 3387348 - protein, 21 aa, Plasmodium falciparum
KSANLILLLCDGCPNSYHVSC

SEQ ID NO: 3387349 - protein, 21 aa, Plasmodium falciparum
KSAYEFLLNENLRKKYNLYLE

SEQ ID NO: 3387350 - protein, 27 aa, Plasmodium falciparum
KSCFSKICFYFADGPWRRTYCKYGYDP

SEQ ID NO: 3387351 - protein, 19 aa, Plasmodium falciparum
KSCKIIKDKVTNNSLQYGF

SEQ ID NO: 3387352 - protein, 36 aa, Plasmodium falciparum
KSCSNWPVINFTNDDNYFFLQKKTDIYIYDTLKLIQ

SEQ ID NO: 3387353 - protein, 25 aa, Plasmodium falciparum
KSCYKKLILLFHPDKNKGTAYLNEK

SEQ ID NO: 3387354 - protein, 33 aa, Plasmodium falciparum
KSDDSKMKIKIQNLLKLIGLLKAQINQKDQEIY

SEQ ID NO: 3387355 - protein, 26 aa, Plasmodium falciparum
KSDELLSLLSQLYFSIQYAHIIIEKY

SEQ ID NO: 3387356 - protein, 23 aa, Plasmodium falciparum
KSDEWIYLQTRCPHPYTAVQICS

SEQ ID NO: 3387357 - protein, 28 aa, Plasmodium falciparum
KSDIYSFYLYLNSYMPCIFLSNTFKMNC

SEQ ID NO: 3387358 - protein, 17 aa, Plasmodium falciparum
KSDLFFSFFHLRKNRIC

SEQ ID NO: 3387359 - protein, 24 aa, Plasmodium falciparum
KSDNIKLYRGFEKNSSHQLILKNN

SEQ ID NO: 3387360 - protein, 21 aa, Plasmodium falciparum
KSEEKIFFQNKSWINQKSMEY

SEQ ID NO: 3387361 - protein, 30 aa, Plasmodium falciparum
KSEINSLPPYLIVHFLRFESKKIVESNNSG

SEQ ID NO: 3387362 - protein, 20 aa, Plasmodium falciparum
KSELKFFFQKLHELFRQMLN

SEQ ID NO: 3387363 - protein, 25 aa, Plasmodium falciparum
KSERRKIGFYINSTFYSFCIVCKNC

SEQ ID NO: 3387364 - protein, 17 aa, Plasmodium falciparum
KSFDKPREGFTSTFGKY

SEQ ID NO: 3387365 - protein, 17 aa, Plasmodium falciparum
KSFFQHMIPYHISTFII

SEQ ID NO: 3387366 - protein, 21 aa, Plasmodium falciparum
KSFIRETVDYYKSLQLKKKED

SEQ ID NO: 3387367 - protein, 33 aa, Plasmodium falciparum
KSFLNFMQHIFLIYKKWWLYDRHNCKHLLDDFY

SEQ ID NO: 3387368 - protein, 17 aa, Plasmodium falciparum
KSFNKLKKYPYEINKFD

SEQ ID NO: 3387369 - protein, 26 aa, Plasmodium falciparum
KSFQSWFHRRWLIEYIYKMNYRKKNN

SEQ ID NO: 3387370 - protein, 20 aa, Plasmodium falciparum
KSFYNFVYPMFKNENIYNFS

SEQ ID NO: 3387371 - protein, 24 aa, Plasmodium falciparum
KSGKNKYFLRKVKEEKINEEKKEN

SEQ ID NO: 3387372 - protein, 25 aa, Plasmodium falciparum
KSGKYVKWSSNYYMKLNSTNGNISD

SEQ ID NO: 3387373 - protein, 18 aa, Plasmodium falciparum
KSGRRWVASWSQNGNQKR

SEQ ID NO: 3387374 - protein, 29 aa, Plasmodium falciparum
KSGYCCIRLSLPLLKLRKIKEYRETLLHE

SEQ ID NO: 3387375 - protein, 30 aa, Plasmodium falciparum
KSHIHNFFCTYDYLKNFHGIKKVDNYIKKI

SEQ ID NO: 3387376 - protein, 26 aa, Plasmodium falciparum
KSHNYYNYFPLYYNDDYMISTHEEKL

SEQ ID NO: 3387377 - protein, 19 aa, Plasmodium falciparum
KSHRENYKYISKRKYSRDN

SEQ ID NO: 3387378 - protein, 29 aa, Plasmodium falciparum
KSICFYEDFIKLREKILLKEKEILEKRNK

SEQ ID NO: 3387379 - protein, 21 aa, Plasmodium falciparum
KSIFEVYFRKCPFNGQFAILA

SEQ ID NO: 3387380 - protein, 18 aa, Plasmodium falciparum
KSIIDIVNYIITIGIWEM

SEQ ID NO: 3387381 - protein, 25 aa, Plasmodium falciparum
KSIKKKKCFFILSLNIDKKNEEKLR

SEQ ID NO: 3387382 - protein, 27 aa, Plasmodium falciparum
KSIKNFINLYVQYIYNAFANFYHKYCN

SEQ ID NO: 3387383 - protein, 23 aa, Plasmodium falciparum
KSIKNIILYIKEKINKIISNITI

SEQ ID NO: 3387384 - protein, 23 aa, Plasmodium falciparum
KSINMSNLLIINKMDYGNDIYHN

SEQ ID NO: 3387385 - protein, 18 aa, Plasmodium falciparum
KSIPQMEAIYYFEIENKQ

SEQ ID NO: 3387386 - protein, 24 aa, Plasmodium falciparum
KSIREWRRWFNYLQVENLVFPDEW

SEQ ID NO: 3387387 - protein, 25 aa, Plasmodium falciparum
KSISDTLMNLPFIKGLADSFTFSKK

SEQ ID NO: 3387388 - protein, 42 aa, Plasmodium falciparum
KSIVIFAKIILILLDYCNLHLDYWSCIYILVASENFFCELEV

SEQ ID NO: 3387389 - protein, 23 aa, Plasmodium falciparum
KSIYEDLLKILITYSYKSKVFKN

SEQ ID NO: 3387390 - protein, 24 aa, Plasmodium falciparum
KSKCGKWQLPIPKIQALNEAEMLR

SEQ ID NO: 3387391 - protein, 25 aa, Plasmodium falciparum
KSKEFLTILLLEFLKSMLTVLNKYN

SEQ ID NO: 3387392 - protein, 25 aa, Plasmodium falciparum
KSKKTIFTEVLYLTSSSNIYSFFEY

SEQ ID NO: 3387393 - protein, 32 aa, Plasmodium falciparum
KSKLGNVPFLKNPVVFFLLQQNFKIVVEYLDQ

SEQ ID NO: 3387394 - protein, 17 aa, Plasmodium falciparum
KSKMNILKHSDILHFQS

SEQ ID NO: 3387395 - protein, 29 aa, Plasmodium falciparum
KSKNFRINTIYPLLKWKINHINDSYIPLN

SEQ ID NO: 3387396 - protein, 24 aa, Plasmodium falciparum
KSKNKMIELLALLKGKHNEDLVEN

SEQ ID NO: 3387397 - protein, 21 aa, Plasmodium falciparum
KSKPLKFVAIKIQKGSETYTE

SEQ ID NO: 3387398 - protein, 21 aa, Plasmodium falciparum
KSKQKEIFSFYVKNIDELIGK

SEQ ID NO: 3387399 - protein, 24 aa, Plasmodium falciparum
KSKSLIPLNLMKNDILYPQLSHDN

SEQ ID NO: 3387400 - protein, 21 aa, Plasmodium falciparum
KSKTISLNNIVLDLSPNEQMT

SEQ ID NO: 3387401 - protein, 18 aa, Plasmodium falciparum
KSLCESYKNYDNDHLLYY

SEQ ID NO: 3387402 - protein, 18 aa, Plasmodium falciparum
KSLESFLVCLNFSLPRSN

SEQ ID NO: 3387403 - protein, 22 aa, Plasmodium falciparum
KSLFNILFSIKYFNEINIDSQY

SEQ ID NO: 3387404 - protein, 19 aa, Plasmodium falciparum
KSLIHMPHSSVSLSHLLFV

SEQ ID NO: 3387405 - protein, 21 aa, Plasmodium falciparum
KSLILKNTLPSLRNICKYGKI

SEQ ID NO: 3387406 - protein, 20 aa, Plasmodium falciparum
KSLIPLNCNGAIKKSSTNTQ

SEQ ID NO: 3387407 - protein, 32 aa, Plasmodium falciparum
KSLIQYIKSICNIFHIFLNESFMLLEKKCHEK

SEQ ID NO: 3387408 - protein, 29 aa, Plasmodium falciparum
KSLIRICHDYIKLLKFSSSLYKCKMLKIS

SEQ ID NO: 3387409 - protein, 23 aa, Plasmodium falciparum
KSLKFFMHPYSKIKNEKSFIDLN

SEQ ID NO: 3387410 - protein, 26 aa, Plasmodium falciparum
KSLKKCFELFYILKLMDINGNIIDKK

SEQ ID NO: 3387411 - protein, 22 aa, Plasmodium falciparum
KSLLHILKREESHLGNKLYSGT

SEQ ID NO: 3387412 - protein, 26 aa, Plasmodium falciparum
KSLMLHNIPHIWINYSYPSKKKLMPW

SEQ ID NO: 3387413 - protein, 17 aa, Plasmodium falciparum
KSLQRELFIFPEDIKTS

SEQ ID NO: 3387414 - protein, 35 aa, Plasmodium falciparum
KSLSKKHSIKYDDEYIPYISDKVKRYKKHKKNKTQ

SEQ ID NO: 3387415 - protein, 19 aa, Plasmodium falciparum
KSLTSHLYRAPIMHNKYLK

SEQ ID NO: 3387416 - protein, 20 aa, Plasmodium falciparum
KSLVENDNFCLNNYRNNFYM

SEQ ID NO: 3387417 - protein, 26 aa, Plasmodium falciparum
KSLVSFIDELFLYNPSLFNNELNNGL

SEQ ID NO: 3387418 - protein, 22 aa, Plasmodium falciparum
KSLYFKKYINLPIPFEERSKSF

SEQ ID NO: 3387419 - protein, 17 aa, Plasmodium falciparum
KSLYNNNILFKKSLYNN

SEQ ID NO: 3387420 - protein, 26 aa, Plasmodium falciparum
KSMCNKRYILKNILNLIKLCNVKDFN

SEQ ID NO: 3387421 - protein, 24 aa, Plasmodium falciparum
KSNDKIILTPISEFIFDKYKKYFN

SEQ ID NO: 3387422 - protein, 30 aa, Plasmodium falciparum
KSNERIMKYLLNFYHFLNKYNYKKCKNKLY

SEQ ID NO: 3387423 - protein, 21 aa, Plasmodium falciparum
KSNFIFLIKQIEKCIVQNIYV

SEQ ID NO: 3387424 - protein, 25 aa, Plasmodium falciparum
KSNFRMHYIVFANVLGLTVHVKKDE

SEQ ID NO: 3387425 - protein, 27 aa, Plasmodium falciparum
KSNIIDAMLFVFGRRAKKIRQNKLSDL

SEQ ID NO: 3387426 - protein, 17 aa, Plasmodium falciparum
KSNPFWWTNQRHDGKLW

SEQ ID NO: 3387427 - protein, 27 aa, Plasmodium falciparum
KSNRGINKILIRSLRKKLKSNLNKLNE

SEQ ID NO: 3387428 - protein, 25 aa, Plasmodium falciparum
KSNRNNYYAYYFYSKKPNNIENNEE

SEQ ID NO: 3387429 - protein, 17 aa, Plasmodium falciparum
KSNSTILNLDNLNIFLK

SEQ ID NO: 3387430 - protein, 23 aa, Plasmodium falciparum
KSNTSPHYLSQKNKNLLSKSYGR

SEQ ID NO: 3387431 - protein, 21 aa, Plasmodium falciparum
KSNYKIIKWIKYLTESGIYQY

SEQ ID NO: 3387432 - protein, 20 aa, Plasmodium falciparum
KSPCGFCFVVYKKKEGYTQA

SEQ ID NO: 3387433 - protein, 18 aa, Plasmodium falciparum
KSPHFLRKNLLYRKPRNK

SEQ ID NO: 3387434 - protein, 32 aa, Plasmodium falciparum
KSPLCNPFFMHKHKPLIFLFINGMKNNSNIKQ

SEQ ID NO: 3387435 - protein, 20 aa, Plasmodium falciparum
KSPYVWLNYDKNDDYCYMND

SEQ ID NO: 3387436 - protein, 21 aa, Plasmodium falciparum
KSQKELYYSYANNGFHCDTNL

SEQ ID NO: 3387437 - protein, 17 aa, Plasmodium falciparum
KSQLRITSFFKRIDKKT

SEQ ID NO: 3387438 - protein, 25 aa, Plasmodium falciparum
KSRDINNLIILPDNYTYAVDSSYMF

SEQ ID NO: 3387439 - protein, 21 aa, Plasmodium falciparum
KSREIIFQTLLNWDKLNECTT

SEQ ID NO: 3387440 - protein, 20 aa, Plasmodium falciparum
KSRFIYIITNYYPFKEQNNP

SEQ ID NO: 3387441 - protein, 34 aa, Plasmodium falciparum
KSRNFDKIIFFKMGRFYEIFYIDACLMHTICSLN

SEQ ID NO: 3387442 - protein, 25 aa, Plasmodium falciparum
KSSKEPMFTLLQMAILLNKKDIVGY

SEQ ID NO: 3387443 - protein, 23 aa, Plasmodium falciparum
KSSKINFLEFLQAFYVVNKSKYS

SEQ ID NO: 3387444 - protein, 25 aa, Plasmodium falciparum
KSSLPFLPIEPKKLARFCNIIREES

SEQ ID NO: 3387445 - protein, 26 aa, Plasmodium falciparum
KSSNNFLYKYYFNTNNSYLKKAFELR

SEQ ID NO: 3387446 - protein, 26 aa, Plasmodium falciparum
KSSSYKSYPKFNKGKRNDAFGKKYSM

SEQ ID NO: 3387447 - protein, 24 aa, Plasmodium falciparum
KSSVLYHMVTFNHGLKNSVIDELK

SEQ ID NO: 3387448 - protein, 26 aa, Plasmodium falciparum
KSSVSLLLLNYALKSGFKPLYIETDT

SEQ ID NO: 3387449 - protein, 32 aa, Plasmodium falciparum
KSSYSIFHLYKNYINMILLFSNCQTLYDFILF

SEQ ID NO: 3387450 - protein, 22 aa, Plasmodium falciparum
KSSYWLLRNSWGSHWGDKGNFK

SEQ ID NO: 3387451 - protein, 18 aa, Plasmodium falciparum
KSTLLQYGARDYYIKAGI

SEQ ID NO: 3387452 - protein, 29 aa, Plasmodium falciparum
KSTNIIWKRFCFYKLLSDKLNDLHISTIS

SEQ ID NO: 3387453 - protein, 27 aa, Plasmodium falciparum
KSTRIENTIIRFDPFVDKKKKNKNKNN

SEQ ID NO: 3387454 - protein, 34 aa, Plasmodium falciparum
KSVCYNQLSIFYKKKIFFQYKGAKYLHNNYNMNV

SEQ ID NO: 3387455 - protein, 26 aa, Plasmodium falciparum
KSVDRDNYIYNVPFVSTIINDNNVRY

SEQ ID NO: 3387456 - protein, 26 aa, Plasmodium falciparum
KSVFLNNIFCSFPFLYKNDHMFMIDI

SEQ ID NO: 3387457 - protein, 25 aa, Plasmodium falciparum
KSVHGCIPLILQSLSLMAKNSSSDI

SEQ ID NO: 3387458 - protein, 24 aa, Plasmodium falciparum
KSVKKFFMLIKNNKNILQNILSFL

SEQ ID NO: 3387459 - protein, 25 aa, Plasmodium falciparum
KSWKKNVYFLRHNPDFMYSLYYNNY

SEQ ID NO: 3387460 - protein, 20 aa, Plasmodium falciparum
KSYFVSNRKNYDQQIFYICK

SEQ ID NO: 3387461 - protein, 19 aa, Plasmodium falciparum
KSYIIKKAIQIIPDKSMDN

SEQ ID NO: 3387462 - protein, 23 aa, Plasmodium falciparum
KSYIYSIAFILLNNQYKTKHCIT

SEQ ID NO: 3387463 - protein, 26 aa, Plasmodium falciparum
KSYKNLLVYDILYKVLQNYRKSMSLY

SEQ ID NO: 3387464 - protein, 17 aa, Plasmodium falciparum
KSYLYNENNLFTCAVYL

SEQ ID NO: 3387465 - protein, 19 aa, Plasmodium falciparum
KSYNFFDKNLTTVYDCSLL

SEQ ID NO: 3387466 - protein, 19 aa, Plasmodium falciparum
KSYPEFFSTNTNNFGLISS

SEQ ID NO: 3387467 - protein, 19 aa, Plasmodium falciparum
KSYSKYILLSYLKCNYNCE

SEQ ID NO: 3387468 - protein, 26 aa, Plasmodium falciparum
KSYSNKNWPFFKWSDSESICTCLINN

SEQ ID NO: 3387469 - protein, 26 aa, Plasmodium falciparum
KTANDIYNYLLLENIPIFITKNDAEK

SEQ ID NO: 3387470 - protein, 21 aa, Plasmodium falciparum
KTAYDLLINKIIRNLANHGDI

SEQ ID NO: 3387471 - protein, 22 aa, Plasmodium falciparum
KTAYLVHKGFVNAVLDVDFSPI

SEQ ID NO: 3387472 - protein, 30 aa, Plasmodium falciparum
KTCGKTRVLFFIPFVVDLLIYHMDNVGIIE

SEQ ID NO: 3387473 - protein, 21 aa, Plasmodium falciparum
KTCIEIRSKAFYKLNRDIMTL

SEQ ID NO: 3387474 - protein, 18 aa, Plasmodium falciparum
KTCIIMKYNIRNDFINSY

SEQ ID NO: 3387475 - protein, 20 aa, Plasmodium falciparum
KTCMKSYLVNCNKIEKFIQN

SEQ ID NO: 3387476 - protein, 26 aa, Plasmodium falciparum
KTCNQYLHYLNKPLIMFNSGAKGALI

SEQ ID NO: 3387477 - protein, 27 aa, Plasmodium falciparum
KTDIWTLGILAFELKFGRPPFGSTNEE

SEQ ID NO: 3387478 - protein, 23 aa, Plasmodium falciparum
KTDIYHDLKDILDIPLKESIERT

SEQ ID NO: 3387479 - protein, 27 aa, Plasmodium falciparum
KTDLKRQLIVPQFSDIILHDLKVKPSV

SEQ ID NO: 3387480 - protein, 28 aa, Plasmodium falciparum
KTDNGFEYIENLYFQKINDYTTNGITKD

SEQ ID NO: 3387481 - protein, 26 aa, Plasmodium falciparum
KTDTWFNYNFPRPQKVWRILASKACR

SEQ ID NO: 3387482 - protein, 18 aa, Plasmodium falciparum
KTDYFGELALIKNIKRTA

SEQ ID NO: 3387483 - protein, 25 aa, Plasmodium falciparum
KTEAFGSNIFIPSNNKVYENKVRDN

SEQ ID NO: 3387484 - protein, 19 aa, Plasmodium falciparum
KTEGNFITRNFFGLFKNEC

SEQ ID NO: 3387485 - protein, 17 aa, Plasmodium falciparum
KTEISFLSLMNCGLTHD

SEQ ID NO: 3387486 - protein, 24 aa, Plasmodium falciparum
KTFKDFYTHKVLKKNSINNSYKNI

SEQ ID NO: 3387487 - protein, 17 aa, Plasmodium falciparum
KTFLLSKSKNITSNVLS

SEQ ID NO: 3387488 - protein, 21 aa, Plasmodium falciparum
KTFLSLFHYFNDKNNLFVNNN

SEQ ID NO: 3387489 - protein, 62 aa, Plasmodium falciparum
KTFRNKNFANFYFKPIYYYSLPYKIIHAWYTGPAHIYFNHPYIPDFIKLICLREKNVLRRKE

SEQ ID NO: 3387490 - protein, 20 aa, Plasmodium falciparum
KTFTDRIKSLFRKKSTKTKE

SEQ ID NO: 3387491 - protein, 23 aa, Plasmodium falciparum
KTGRRVWISYILIKNLNDSKDHA

SEQ ID NO: 3387492 - protein, 32 aa, Plasmodium falciparum
KTIKLANLVSFNKWMVTLKLASFIPAAIDYED

SEQ ID NO: 3387493 - protein, 24 aa, Plasmodium falciparum
KTIKPIMVPVLPTVGTPVNVSARP

SEQ ID NO: 3387494 - protein, 30 aa, Plasmodium falciparum
KTINLSPKKKFFFFFRTIKGRRRKEKYEDL

SEQ ID NO: 3387495 - protein, 22 aa, Plasmodium falciparum
KTIRSHLVLKNDFTVSYVKKSV

SEQ ID NO: 3387496 - protein, 25 aa, Plasmodium falciparum
KTISNLKMPNLTVPILMTTNEGLKS

SEQ ID NO: 3387497 - protein, 19 aa, Plasmodium falciparum
KTIVFVLPLIMKCLEAEIR

SEQ ID NO: 3387498 - protein, 31 aa, Plasmodium falciparum
KTKCDNCFYNLKGYLFFPLSYEHIEKERYSI

SEQ ID NO: 3387499 - protein, 30 aa, Plasmodium falciparum
KTKFPGINKSKIICGTPPYMPPESFDGIVS

SEQ ID NO: 3387500 - protein, 25 aa, Plasmodium falciparum
KTKINKIILINLLYDIIVNNSYDNR

SEQ ID NO: 3387501 - protein, 26 aa, Plasmodium falciparum
KTKKDMFDFLYLYSIKFFKAKRVEGN

SEQ ID NO: 3387502 - protein, 22 aa, Plasmodium falciparum
KTKKKKYMPPSSNFPHIVNNKN

SEQ ID NO: 3387503 - protein, 17 aa, Plasmodium falciparum
KTKLHIKGVLKLDNISF

SEQ ID NO: 3387504 - protein, 21 aa, Plasmodium falciparum
KTKLKVINKIRLTKKGKDFLD

SEQ ID NO: 3387505 - protein, 29 aa, Plasmodium falciparum
KTKRETHLMYLLFDLLNLRCAELHGSMSQ

SEQ ID NO: 3387506 - protein, 26 aa, Plasmodium falciparum
KTKRIDNHFFLFKRFNSFDKIHSLDK

SEQ ID NO: 3387507 - protein, 24 aa, Plasmodium falciparum
KTKSNFIHYLIHEIDLKNNKKNLG

SEQ ID NO: 3387508 - protein, 35 aa, Plasmodium falciparum
KTKYRNVLVNICKKIFLLKYYSAKDKLHFNKKYEN

SEQ ID NO: 3387509 - protein, 20 aa, Plasmodium falciparum
KTLFLLTCTSTLSVGLNLFV

SEQ ID NO: 3387510 - protein, 41 aa, Plasmodium falciparum
KTLICYYSKLLASHPCIKYIFRFFFLKYASITTVSTNLGEM

SEQ ID NO: 3387511 - protein, 24 aa, Plasmodium falciparum
KTLILNWVSFFKTNWKDLFNIDKE

SEQ ID NO: 3387512 - protein, 23 aa, Plasmodium falciparum
KTLKILIFYIPYNDSIKKKITEK

SEQ ID NO: 3387513 - protein, 24 aa, Plasmodium falciparum
KTLKPLPLPMHDQKVEWQPVYHET

SEQ ID NO: 3387514 - protein, 20 aa, Plasmodium falciparum
KTLLDFLKVWNPDLSLFQVY

SEQ ID NO: 3387515 - protein, 22 aa, Plasmodium falciparum
KTLNFKRSFSISSNIGDYFYDI

SEQ ID NO: 3387516 - protein, 27 aa, Plasmodium falciparum
KTLQTISLLCYLRFNKNIKKKSIIICP

SEQ ID NO: 3387517 - protein, 17 aa, Plasmodium falciparum
KTLWRRDDGGYGRYNSR

SEQ ID NO: 3387518 - protein, 18 aa, Plasmodium falciparum
KTMFSYFGEIRNIKYVND

SEQ ID NO: 3387519 - protein, 27 aa, Plasmodium falciparum
KTMIYKYYLKYILKNKSRYLFSNIIVY

SEQ ID NO: 3387520 - protein, 27 aa, Plasmodium falciparum
KTMNPPKKFPLLLKNKGKSPPFIQKNN

SEQ ID NO: 3387521 - protein, 29 aa, Plasmodium falciparum
KTMTLLDFLIILDKIWEIFRQNCVIMFLH

SEQ ID NO: 3387522 - protein, 18 aa, Plasmodium falciparum
KTMTVYFLDIIESIVRVV

SEQ ID NO: 3387523 - protein, 27 aa, Plasmodium falciparum
KTNDIIYYVFALILYEQDKKMNKQNKQ

SEQ ID NO: 3387524 - protein, 24 aa, Plasmodium falciparum
KTNEYMKLLILKKLPQLKIVDNET

SEQ ID NO: 3387525 - protein, 26 aa, Plasmodium falciparum
KTNIHYWRNVIDYFFYRCANLKPLDR

SEQ ID NO: 3387526 - protein, 22 aa, Plasmodium falciparum
KTNILNSYQKGIYKLIELRTNE

SEQ ID NO: 3387527 - protein, 47 aa, Plasmodium falciparum
KTNKICNNIILNKIYYLCFFNNFFSYRTLYEYKYIYIYNSKGKKELN

SEQ ID NO: 3387528 - protein, 26 aa, Plasmodium falciparum
KTNKNLIYELIFIKGLIYKRNGNYLG

SEQ ID NO: 3387529 - protein, 23 aa, Plasmodium falciparum
KTNKTLLNLYNKKFSNINYIISL

SEQ ID NO: 3387530 - protein, 55 aa, Plasmodium falciparum
KTNKYIKVRKNKYFKFSHLYTMYIQNNFDYLYKKNSSIYYIINLKSVDMMCHNVD

SEQ ID NO: 3387531 - protein, 21 aa, Plasmodium falciparum
KTNPLKLTIPLVFKRIKYTYE

SEQ ID NO: 3387532 - protein, 28 aa, Plasmodium falciparum
KTNYMEQIILKIRLLIVFPNNHIVILTN

SEQ ID NO: 3387533 - protein, 29 aa, Plasmodium falciparum
KTNYPLAIQTIFRYIFDKTFKLHDLDFKL

SEQ ID NO: 3387534 - protein, 25 aa, Plasmodium falciparum
KTPNKYIYILFEYNTKNIFFTLLQN

SEQ ID NO: 3387535 - protein, 23 aa, Plasmodium falciparum
KTPRNVFFPWHTFCIHKSGSFLE

SEQ ID NO: 3387536 - protein, 26 aa, Plasmodium falciparum
KTPRTSYFYNLFFPDLINNDSVYDSS

SEQ ID NO: 3387537 - protein, 31 aa, Plasmodium falciparum
KTPVENMFLEQIYKSFPYSSLPKIISVKQPY

SEQ ID NO: 3387538 - protein, 54 aa, Plasmodium falciparum
KTPYDINMFFLPFELSTKLRFKDFKKYFPFKGNIIFRFKIALCDMINVINEGII

SEQ ID NO: 3387539 - protein, 26 aa, Plasmodium falciparum
KTQELTNLLLFLMPHIFTETNINNAM

SEQ ID NO: 3387540 - protein, 17 aa, Plasmodium falciparum
KTRKLIEILDALEFNQV

SEQ ID NO: 3387541 - protein, 20 aa, Plasmodium falciparum
KTRMKDIRNLNDPPKVNNNE

SEQ ID NO: 3387542 - protein, 25 aa, Plasmodium falciparum
KTRYGYISLPDRSPFGILYICKIKK

SEQ ID NO: 3387543 - protein, 23 aa, Plasmodium falciparum
KTSAYFFDIPLQRIFDSFDMKHF

SEQ ID NO: 3387544 - protein, 25 aa, Plasmodium falciparum
KTSIDSVFFKSLSKDSYDLYNKNKE

SEQ ID NO: 3387545 - protein, 17 aa, Plasmodium falciparum
KTSILSMKSKITKISSL

SEQ ID NO: 3387546 - protein, 30 aa, Plasmodium falciparum
KTSKYGEYLYLIDTYIISELIHNISGLHYY

SEQ ID NO: 3387547 - protein, 27 aa, Plasmodium falciparum
KTTILSRFDIIFLLRNKQDVEKDTLLC

SEQ ID NO: 3387548 - protein, 27 aa, Plasmodium falciparum
KTTKKKIHWLPYLPQQLITCTLYEYDH

SEQ ID NO: 3387549 - protein, 22 aa, Plasmodium falciparum
KTTNFQTILPIQIKKEIPYEKE

SEQ ID NO: 3387550 - protein, 22 aa, Plasmodium falciparum
KTVSFIEILLSREQLDMKDAGY

SEQ ID NO: 3387551 - protein, 59 aa, Plasmodium falciparum
KTYELLRSLVLLTQTLEPLPERTYLSMKLLYYDEIVPYNYQPPYFRNPDNNDLLKFIDI

SEQ ID NO: 3387552 - protein, 17 aa, Plasmodium falciparum
KTYGYLTPDLWKVTNFD

SEQ ID NO: 3387553 - protein, 20 aa, Plasmodium falciparum
KTYINVPNNIVTKMFNDTNR

SEQ ID NO: 3387554 - protein, 24 aa, Plasmodium falciparum
KTYKIKLPFHAICSKPLVLCEPLF

SEQ ID NO: 3387555 - protein, 22 aa, Plasmodium falciparum
KTYLNKIFHYKKKKDARFFIND

SEQ ID NO: 3387556 - protein, 27 aa, Plasmodium falciparum
KTYNKLKTCLILFSPIIEMHKRHKQYV

SEQ ID NO: 3387557 - protein, 17 aa, Plasmodium falciparum
KTYSLIRKILSNFTLII

SEQ ID NO: 3387558 - protein, 31 aa, Plasmodium falciparum
KVAINSLSIYPYILQVLYNNDIFESKDIIKR

SEQ ID NO: 3387559 - protein, 23 aa, Plasmodium falciparum
KVCAGFLLFYYPLDKLHCNIRRF

SEQ ID NO: 3387560 - protein, 26 aa, Plasmodium falciparum
KVCDNKVFYEYIKKSYFVSNRKNYDQ

SEQ ID NO: 3387561 - protein, 26 aa, Plasmodium falciparum
KVDIFSLGVILFNILCGYPPFRGNNV

SEQ ID NO: 3387562 - protein, 18 aa, Plasmodium falciparum
KVDKVYRKLLEDSFEFLE

SEQ ID NO: 3387563 - protein, 24 aa, Plasmodium falciparum
KVDNLSYIKNILQQQLFPKEKTGE

SEQ ID NO: 3387564 - protein, 28 aa, Plasmodium falciparum
KVDNVNIIFLLYPPNCGVKRLVELTCYA

SEQ ID NO: 3387565 - protein, 27 aa, Plasmodium falciparum
KVELDKPYILIHEKKISTVKSLLPVLE

SEQ ID NO: 3387566 - protein, 17 aa, Plasmodium falciparum
KVELVLMPELRKIRIYI

SEQ ID NO: 3387567 - protein, 26 aa, Plasmodium falciparum
KVENAGFMFYIKYEVPLLLNEGDNIK

SEQ ID NO: 3387568 - protein, 24 aa, Plasmodium falciparum
KVENIYHCFKCLKSVLHICIDDED

SEQ ID NO: 3387569 - protein, 25 aa, Plasmodium falciparum
KVFDLFTGTYLWKSKGLGVSLLHLN

SEQ ID NO: 3387570 - protein, 32 aa, Plasmodium falciparum
KVFQIFRGRAAFLSDILIILISLEVGAEIQTE

SEQ ID NO: 3387571 - protein, 24 aa, Plasmodium falciparum
KVFSHTHLSLYEIPPLLPDNYSSL

SEQ ID NO: 3387572 - protein, 18 aa, Plasmodium falciparum
KVFVFKKFAEDFKKEAKV

SEQ ID NO: 3387573 - protein, 22 aa, Plasmodium falciparum
KVGTPLYMVHAYIPAIESFGFE

SEQ ID NO: 3387574 - protein, 25 aa, Plasmodium falciparum
KVGYNKFYLLISSFCPRIIMNSYIK

SEQ ID NO: 3387575 - protein, 19 aa, Plasmodium falciparum
KVHEHIVPSEWFHLQNYNT

SEQ ID NO: 3387576 - protein, 27 aa, Plasmodium falciparum
KVHLIKCPILFIHGKKDKLLSYHGTEE

SEQ ID NO: 3387577 - protein, 19 aa, Plasmodium falciparum
KVIDILKRKINGMKTTFSE

SEQ ID NO: 3387578 - protein, 18 aa, Plasmodium falciparum
KVIIILNGRRAGKKAVIV

SEQ ID NO: 3387579 - protein, 27 aa, Plasmodium falciparum
KVIQIKPNYLLLYLAPKVIGKLMYDKN

SEQ ID NO: 3387580 - protein, 22 aa, Plasmodium falciparum
KVIVVPHRFPGVYLLKGKSDIL

SEQ ID NO: 3387581 - protein, 25 aa, Plasmodium falciparum
KVKAKKIFYQRALNNIYLCTIRTMI

SEQ ID NO: 3387582 - protein, 24 aa, Plasmodium falciparum
KVKIKTPVNMFYKRKKKLKIVKKK

SEQ ID NO: 3387583 - protein, 30 aa, Plasmodium falciparum
KVKILKQETILFILIYIMQNKETPTLSDIC

SEQ ID NO: 3387584 - protein, 26 aa, Plasmodium falciparum
KVKKLQNPLIPYTPIDTSYAYQTPPS

SEQ ID NO: 3387585 - protein, 19 aa, Plasmodium falciparum
KVKLFYDYLIIAVGAKTNT

SEQ ID NO: 3387586 - protein, 25 aa, Plasmodium falciparum
KVKLNTLMLQSYLHKSYDKVSNILK

SEQ ID NO: 3387587 - protein, 17 aa, Plasmodium falciparum
KVKTQLNNNIKNSYYIP

SEQ ID NO: 3387588 - protein, 35 aa, Plasmodium falciparum
KVLDLRSNFINHPVQLFYILDNKNWLKKYQKNKME

SEQ ID NO: 3387589 - protein, 27 aa, Plasmodium falciparum
KVLISAVKIQYQKILQLQKLIENQKSD

SEQ ID NO: 3387590 - protein, 17 aa, Plasmodium falciparum
KVLLNPLYEPNGIITSS

SEQ ID NO: 3387591 - protein, 27 aa, Plasmodium falciparum
KVLLTTLNEVLWKNAQWKNVYMADLIS

SEQ ID NO: 3387592 - protein, 27 aa, Plasmodium falciparum
KVLNKIDNIIFFSNLKLDNIYKKRNPH

SEQ ID NO: 3387593 - protein, 26 aa, Plasmodium falciparum
KVLVNKFPVDIYGYNNAYEMAVHCIN

SEQ ID NO: 3387594 - protein, 35 aa, Plasmodium falciparum
KVNHSKYEHFPWYKRLYYIMKDYIYNILKIKEEGM

SEQ ID NO: 3387595 - protein, 31 aa, Plasmodium falciparum
KVNKRKIPKIKFKTIKQIYNYDFDAIMVKDG

SEQ ID NO: 3387596 - protein, 41 aa, Plasmodium falciparum
KVNNNIYICQFKDKLNKVHKHFFPIYKYGDASTAKNRAHML

SEQ ID NO: 3387597 - protein, 24 aa, Plasmodium falciparum
KVNNSFLKNINFIKAFDNLQKNNP

SEQ ID NO: 3387598 - protein, 25 aa, Plasmodium falciparum
KVNSLRLRKLAELCLGIRACDHSVE

SEQ ID NO: 3387599 - protein, 24 aa, Plasmodium falciparum
KVPNIGFISLKMDIKLFNACKDFS

SEQ ID NO: 3387600 - protein, 28 aa, Plasmodium falciparum
KVQCHIFNIFYKFYLNNVIPIIGKVVAN

SEQ ID NO: 3387601 - protein, 33 aa, Plasmodium falciparum
KVQCMLKLLTRKNIFMLPSLYTNDNDYIINEEY

SEQ ID NO: 3387602 - protein, 24 aa, Plasmodium falciparum
KVQIQLNDSWGGKGLLGCNVATGY

SEQ ID NO: 3387603 - protein, 26 aa, Plasmodium falciparum
KVQKTKIVIYFSKNIPVLFSVNNIIY

SEQ ID NO: 3387604 - protein, 21 aa, Plasmodium falciparum
KVQTKIRTKLKLRMKDDDKLN

SEQ ID NO: 3387605 - protein, 24 aa, Plasmodium falciparum
KVRIKICLEDFFNKNKEIYNAIDI

SEQ ID NO: 3387606 - protein, 48 aa, Plasmodium falciparum
KVRKIFENVGKVKDVYLPLDHYTRKPRGFGFVEYFESKYAKEAINILN

SEQ ID NO: 3387607 - protein, 30 aa, Plasmodium falciparum
KVSITFDPFMYLSIPLPPKKNHRVWFHVIL

SEQ ID NO: 3387608 - protein, 22 aa, Plasmodium falciparum
KVSKGWVRRFQKKQIKLNEQKN

SEQ ID NO: 3387609 - protein, 26 aa, Plasmodium falciparum
KVSNNPLLYLIDTPGIFLPKLEDKEI

SEQ ID NO: 3387610 - protein, 27 aa, Plasmodium falciparum
KVSVHISGLYNTFMDILNYNSSDALNN

SEQ ID NO: 3387611 - protein, 30 aa, Plasmodium falciparum
KVSYNDSKFLLYFLLNEEEIYKKLFEKLNL

SEQ ID NO: 3387612 - protein, 26 aa, Plasmodium falciparum
KVTFIQWDNILYKPRLLICTCTCYLF

SEQ ID NO: 3387613 - protein, 19 aa, Plasmodium falciparum
KVTGIHIYSLCKHHLLPFE

SEQ ID NO: 3387614 - protein, 18 aa, Plasmodium falciparum
KVTKLNLLKLAPGGSIGR

SEQ ID NO: 3387615 - protein, 39 aa, Plasmodium falciparum
KVVDNFDWTLEILNNLYNVELPILYKMFDINSICVSLKL

SEQ ID NO: 3387616 - protein, 17 aa, Plasmodium falciparum
KVVETYKSSFKVQEENV

SEQ ID NO: 3387617 - protein, 19 aa, Plasmodium falciparum
KVVFSAVRVLSALLSHLIK

SEQ ID NO: 3387618 - protein, 19 aa, Plasmodium falciparum
KVVLITMGKHIFGTKVELI

SEQ ID NO: 3387619 - protein, 20 aa, Plasmodium falciparum
KVVNIWLDTKNIDGKIYIKY

SEQ ID NO: 3387620 - protein, 41 aa, Plasmodium falciparum
KVWNNPIFIDFLSYIKLKIPLFNFYEMFLFVLCFSKIEFMP

SEQ ID NO: 3387621 - protein, 18 aa, Plasmodium falciparum
KVYEFIFGENYISSGGLE

SEQ ID NO: 3387622 - protein, 34 aa, Plasmodium falciparum
KVYGKKVAPRFLISKKVKMFYKYDKFYQKFRELV

SEQ ID NO: 3387623 - protein, 17 aa, Plasmodium falciparum
KVYIFNFDNILNIIREN

SEQ ID NO: 3387624 - protein, 26 aa, Plasmodium falciparum
KWCSSPKEFLIFMKNALESNYVNQNI

SEQ ID NO: 3387625 - protein, 17 aa, Plasmodium falciparum
KWDIIYQDLPNKTTNNI

SEQ ID NO: 3387626 - protein, 23 aa, Plasmodium falciparum
KWEDLIKDIILSDALDELDKYNA

SEQ ID NO: 3387627 - protein, 26 aa, Plasmodium falciparum
KWGDMYYYFYIFYKNQCIYSIDLKNN

SEQ ID NO: 3387628 - protein, 32 aa, Plasmodium falciparum
KWIKKKILNENYKLFYLKKKMCKSYKTSIILL

SEQ ID NO: 3387629 - protein, 22 aa, Plasmodium falciparum
KWKEASCCILKNALLHKKNNET

SEQ ID NO: 3387630 - protein, 20 aa, Plasmodium falciparum
KWLSQKNVLLNILKNQKKLK

SEQ ID NO: 3387631 - protein, 18 aa, Plasmodium falciparum
KWNIHLSKITLKFNNINH

SEQ ID NO: 3387632 - protein, 26 aa, Plasmodium falciparum
KWNNKNLLFFQKVIKILYCIKSKPEI

SEQ ID NO: 3387633 - protein, 21 aa, Plasmodium falciparum
KWPHNPVSIIIKHLKKYFNKN

SEQ ID NO: 3387634 - protein, 17 aa, Plasmodium falciparum
KWRAVIFGPADTPWEGG

SEQ ID NO: 3387635 - protein, 26 aa, Plasmodium falciparum
KWSPVCTAVYKMYPHFSFNTNEQLSY

SEQ ID NO: 3387636 - protein, 31 aa, Plasmodium falciparum
KWSVEKILHVFKRIITMKPNALEIIFENEKR

SEQ ID NO: 3387637 - protein, 19 aa, Plasmodium falciparum
KYDCHFIIVNDVYDIKYKR

SEQ ID NO: 3387638 - protein, 20 aa, Plasmodium falciparum
KYDDKMLYDIYLKEKENIQN

SEQ ID NO: 3387639 - protein, 35 aa, Plasmodium falciparum
KYDEKMHVLFSDSFKFLPLAYVLNKNIFICHGGIP

SEQ ID NO: 3387640 - protein, 23 aa, Plasmodium falciparum
KYDETLTGFKWIINKAIEYNEQN

SEQ ID NO: 3387641 - protein, 21 aa, Plasmodium falciparum
KYDEYIINQDVLKINNMKACD

SEQ ID NO: 3387642 - protein, 19 aa, Plasmodium falciparum
KYDILLQQFLEILNSINND

SEQ ID NO: 3387643 - protein, 20 aa, Plasmodium falciparum
KYDKGLLNKIYYKNEEKNIQ

SEQ ID NO: 3387644 - protein, 29 aa, Plasmodium falciparum
KYDKKQYKQILYYIYTISSDELLEKFFKN

SEQ ID NO: 3387645 - protein, 24 aa, Plasmodium falciparum
KYDLNRPLPNYYMLHCYNIKNYQD

SEQ ID NO: 3387646 - protein, 22 aa, Plasmodium falciparum
KYDNFRIKFDPLYKTKTGGTGD

SEQ ID NO: 3387647 - protein, 26 aa, Plasmodium falciparum
KYDNYFEPFNYFYKYEYLYTDNPSCR

SEQ ID NO: 3387648 - protein, 35 aa, Plasmodium falciparum
KYDPTKVDIFCVGYILYFCLTKHELFKCSLDKDIY

SEQ ID NO: 3387649 - protein, 17 aa, Plasmodium falciparum
KYDYLIFDEAHFLKNKN

SEQ ID NO: 3387650 - protein, 26 aa, Plasmodium falciparum
KYEELLLTYPLYKYQIDLVLGRGLAL

SEQ ID NO: 3387651 - protein, 27 aa, Plasmodium falciparum
KYEIYIYNNLQWDLFFGGIENINEEEL

SEQ ID NO: 3387652 - protein, 18 aa, Plasmodium falciparum
KYEKLQRNLNMKYQLLKN

SEQ ID NO: 3387653 - protein, 18 aa, Plasmodium falciparum
KYENSFIHQLINDLIHNN

SEQ ID NO: 3387654 - protein, 18 aa, Plasmodium falciparum
KYENVLATILYDSRYLNV

SEQ ID NO: 3387655 - protein, 28 aa, Plasmodium falciparum
KYESHIFKTIIYLSCLFMNNEEKKRMDN

SEQ ID NO: 3387656 - protein, 20 aa, Plasmodium falciparum
KYFDELYNFANYRVSPIGMD

SEQ ID NO: 3387657 - protein, 26 aa, Plasmodium falciparum
KYFDYYIYLYNIDALLIYTTHKFHLF

SEQ ID NO: 3387658 - protein, 20 aa, Plasmodium falciparum
KYFGYYLTGDMSTELILICK

SEQ ID NO: 3387659 - protein, 20 aa, Plasmodium falciparum
KYFHNLLNNYDNYNFYNFLF

SEQ ID NO: 3387660 - protein, 19 aa, Plasmodium falciparum
KYFKNIILGAITDLYNSYK

SEQ ID NO: 3387661 - protein, 18 aa, Plasmodium falciparum
KYFKVGIIGSGPSALYCC

SEQ ID NO: 3387662 - protein, 20 aa, Plasmodium falciparum
KYFPIKLYRRIIIELLNMEH

SEQ ID NO: 3387663 - protein, 21 aa, Plasmodium falciparum
KYFQINQLHFIRIINKNIHSK

SEQ ID NO: 3387664 - protein, 19 aa, Plasmodium falciparum
KYFSGLNKNLYLEKKKRGV

SEQ ID NO: 3387665 - protein, 24 aa, Plasmodium falciparum
KYFSYVCSRYYRAPELLFGSNYYS

SEQ ID NO: 3387666 - protein, 32 aa, Plasmodium falciparum
KYFTDEINWFSEFFLPYKIGDYIENLIVQIWA

SEQ ID NO: 3387667 - protein, 23 aa, Plasmodium falciparum
KYFYDMVASLKKAGANFVICQWG

SEQ ID NO: 3387668 - protein, 17 aa, Plasmodium falciparum
KYFYFLTELVTGGELYD

SEQ ID NO: 3387669 - protein, 18 aa, Plasmodium falciparum
KYFYVPSIYPEYITKHVL

SEQ ID NO: 3387670 - protein, 26 aa, Plasmodium falciparum
KYGANTFLYDYTWKGILFNLCGTVAS

SEQ ID NO: 3387671 - protein, 17 aa, Plasmodium falciparum
KYGKLQFNKSFFQQFIK

SEQ ID NO: 3387672 - protein, 29 aa, Plasmodium falciparum
KYGKTLEVVLPVFSYRTYEYLKRVSKKTQ

SEQ ID NO: 3387673 - protein, 25 aa, Plasmodium falciparum
KYGRSNFFILITNTDMRILNGKFPD

SEQ ID NO: 3387674 - protein, 20 aa, Plasmodium falciparum
KYHENFLSNVRKHYKKKSIN

SEQ ID NO: 3387675 - protein, 43 aa, Plasmodium falciparum
KYHILYKKALKPTWFQEYRKNEVNFFFLFDRKRNIISGNISEN

SEQ ID NO: 3387676 - protein, 24 aa, Plasmodium falciparum
KYHYIDRMFLYRHAKNVIDDADYE

SEQ ID NO: 3387677 - protein, 27 aa, Plasmodium falciparum
KYICDSDLFLTFVQLFLDLIKNKDSNL

SEQ ID NO: 3387678 - protein, 17 aa, Plasmodium falciparum
KYIDKYDMKNLIDEIKK

SEQ ID NO: 3387679 - protein, 29 aa, Plasmodium falciparum
KYIEKENILIFYIKNHPNYFEILNNTSYH

SEQ ID NO: 3387680 - protein, 20 aa, Plasmodium falciparum
KYIFILIKILNIINKKFFYI

SEQ ID NO: 3387681 - protein, 25 aa, Plasmodium falciparum
KYIHKPLLINGLKFDIRLYVLLTGC

SEQ ID NO: 3387682 - protein, 22 aa, Plasmodium falciparum
KYIIDIRIFIKKMYISSILQKK

SEQ ID NO: 3387683 - protein, 20 aa, Plasmodium falciparum
KYIILARIKYEKYINNIFCK

SEQ ID NO: 3387684 - protein, 30 aa, Plasmodium falciparum
KYIINKLTELFLLIYKERLKRMLLYCSNVE

SEQ ID NO: 3387685 - protein, 18 aa, Plasmodium falciparum
KYIKLLYISIDIGKQFGT

SEQ ID NO: 3387686 - protein, 22 aa, Plasmodium falciparum
KYILAIEKYLKTPIVWIGVGPN

SEQ ID NO: 3387687 - protein, 20 aa, Plasmodium falciparum
KYILLCMEEFFKKQKYYDVR

SEQ ID NO: 3387688 - protein, 30 aa, Plasmodium falciparum
KYIMKVKNMILFKNNILTKDFLFDSSFSSD

SEQ ID NO: 3387689 - protein, 25 aa, Plasmodium falciparum
KYINFKHFYNFLIFFEHLYKKKSEE

SEQ ID NO: 3387690 - protein, 18 aa, Plasmodium falciparum
KYINSLLCDEKDKYDIVV

SEQ ID NO: 3387691 - protein, 20 aa, Plasmodium falciparum
KYINSLMYPNNTIPKKEEIE

SEQ ID NO: 3387692 - protein, 26 aa, Plasmodium falciparum
KYISKWLVVSILWGIGGSLNLETREK

SEQ ID NO: 3387693 - protein, 61 aa, Plasmodium falciparum
KYISMVHDIIYKKYMLLNNTIFPRNLHESEILYTLFPHEPHTFMFLYTDDNFQYQNEVFLK

SEQ ID NO: 3387694 - protein, 22 aa, Plasmodium falciparum
KYISQRFLYMSSSLKVRVLTSF

SEQ ID NO: 3387695 - protein, 33 aa, Plasmodium falciparum
KYIVKDINLIKIFDLFKDIYLLNNGDFYDYFLE

SEQ ID NO: 3387696 - protein, 19 aa, Plasmodium falciparum
KYIYIYTHMNPKMSQKTHT

SEQ ID NO: 3387697 - protein, 28 aa, Plasmodium falciparum
KYKALKEIFLIYPIKFMCVKKIQRNKKA

SEQ ID NO: 3387698 - protein, 28 aa, Plasmodium falciparum
KYKCTPQSIMIPILDKDNFLNSKICDNN

SEQ ID NO: 3387699 - protein, 20 aa, Plasmodium falciparum
KYKFKHEYLFKNASFEVDMD

SEQ ID NO: 3387700 - protein, 30 aa, Plasmodium falciparum
KYKGKKFEIACYKNKIIDWKNGTELNIDDV

SEQ ID NO: 3387701 - protein, 34 aa, Plasmodium falciparum
KYKHVLNLFHMNSIFYLYVNFNQYNKQFFLDNDI

SEQ ID NO: 3387702 - protein, 18 aa, Plasmodium falciparum
KYKIAKEMLLLSDSNSSS

SEQ ID NO: 3387703 - protein, 17 aa, Plasmodium falciparum
KYKIFIEQALDDFIIKT

SEQ ID NO: 3387704 - protein, 26 aa, Plasmodium falciparum
KYKIKFSQTCLSCFSTFIGCTFISCN

SEQ ID NO: 3387705 - protein, 27 aa, Plasmodium falciparum
KYKINKYLFRIIYNLLKDYFSNKSINI

SEQ ID NO: 3387706 - protein, 20 aa, Plasmodium falciparum
KYKLDLCTNLFLFPDHKYKG

SEQ ID NO: 3387707 - protein, 34 aa, Plasmodium falciparum
KYKLDVPLLSIMENLIILHLINEYKINNIVKKIQ

SEQ ID NO: 3387708 - protein, 28 aa, Plasmodium falciparum
KYKLKYTNDMLLYKLLNNKKNEIFSFQD

SEQ ID NO: 3387709 - protein, 20 aa, Plasmodium falciparum
KYKMFIEVVLEPLNRDTFNL

SEQ ID NO: 3387710 - protein, 17 aa, Plasmodium falciparum
KYKNECNFVYYQNYNNT

SEQ ID NO: 3387711 - protein, 24 aa, Plasmodium falciparum
KYKNIHNLFYFMNIHEILLKEEDN

SEQ ID NO: 3387712 - protein, 35 aa, Plasmodium falciparum
KYKNNELIYILYIYKYHNYLNPFLILHIIDKLCCD

SEQ ID NO: 3387713 - protein, 27 aa, Plasmodium falciparum
KYKQNNMDLINRLSLNNSLMNSQKIEI

SEQ ID NO: 3387714 - protein, 23 aa, Plasmodium falciparum
KYKQNYLNLMKIYKIYNRFVNKT

SEQ ID NO: 3387715 - protein, 19 aa, Plasmodium falciparum
KYKSISIFIENLDRYYYFL

SEQ ID NO: 3387716 - protein, 21 aa, Plasmodium falciparum
KYKYIHAVNLKHFINHKVVKN

SEQ ID NO: 3387717 - protein, 24 aa, Plasmodium falciparum
KYKYRSNIIFTINKIKNLESIIEI

SEQ ID NO: 3387718 - protein, 25 aa, Plasmodium falciparum
KYKYVCYFLEEFFFHKQKISQKVYN

SEQ ID NO: 3387719 - protein, 18 aa, Plasmodium falciparum
KYLDPLEKDIPLVDLNIH

SEQ ID NO: 3387720 - protein, 20 aa, Plasmodium falciparum
KYLIDLIYNLQEYLNPDDIN

SEQ ID NO: 3387721 - protein, 26 aa, Plasmodium falciparum
KYLKGHLFKFLYKYFQVHTDLRDLLN

SEQ ID NO: 3387722 - protein, 18 aa, Plasmodium falciparum
KYLNKFYNKNVRLVGKVL

SEQ ID NO: 3387723 - protein, 27 aa, Plasmodium falciparum
KYLNLYALCFFILKENYYYLSIDNLYL

SEQ ID NO: 3387724 - protein, 20 aa, Plasmodium falciparum
KYLNNILNLNNCNCSNIHTP

SEQ ID NO: 3387725 - protein, 25 aa, Plasmodium falciparum
KYLNYNHFFRHPILKNEKIKNIYPI

SEQ ID NO: 3387726 - protein, 23 aa, Plasmodium falciparum
KYLPHLRCLNLSNNLIKCQGAIN

SEQ ID NO: 3387727 - protein, 21 aa, Plasmodium falciparum
KYMDFLYDCDIDNILIPLSIY

SEQ ID NO: 3387728 - protein, 35 aa, Plasmodium falciparum
KYMSNEKALFEKFLKSFISLFFQDECIDQFLNYYD

SEQ ID NO: 3387729 - protein, 17 aa, Plasmodium falciparum
KYMTCNDKNIGAIENEL

SEQ ID NO: 3387730 - protein, 26 aa, Plasmodium falciparum
KYNENEYNFIFSNEYYSDSCQPNIDE

SEQ ID NO: 3387731 - protein, 28 aa, Plasmodium falciparum
KYNFDEEDLWFLCDLCNNPISPLCYVYE

SEQ ID NO: 3387732 - protein, 21 aa, Plasmodium falciparum
KYNGFYLGSIGGPGAILAKNN

SEQ ID NO: 3387733 - protein, 31 aa, Plasmodium falciparum
KYNHLFYRHFKIWCDLYFRIKHRNINRGIGG

SEQ ID NO: 3387734 - protein, 18 aa, Plasmodium falciparum
KYNHLNCFCFKLHVKFSS

SEQ ID NO: 3387735 - protein, 32 aa, Plasmodium falciparum
KYNINDVYKVIKSFLFKYMENDKKRGVNKMVG

SEQ ID NO: 3387736 - protein, 20 aa, Plasmodium falciparum
KYNKKLCFPQNNLLSDFRSE

SEQ ID NO: 3387737 - protein, 21 aa, Plasmodium falciparum
KYNKYAILKDKGSKMNNNNNN

SEQ ID NO: 3387738 - protein, 24 aa, Plasmodium falciparum
KYNLDMNLFYLYNNQNMPNPYIYI

SEQ ID NO: 3387739 - protein, 35 aa, Plasmodium falciparum
KYNLEIPMKFLLYISKYYSFVFKGKSFFQHMIPYH

SEQ ID NO: 3387740 - protein, 17 aa, Plasmodium falciparum
KYNLRKIIGVTKLKLEI

SEQ ID NO: 3387741 - protein, 22 aa, Plasmodium falciparum
KYNNCKNYKRKYSKYYRTDERD

SEQ ID NO: 3387742 - protein, 20 aa, Plasmodium falciparum
KYNNIYKHDVNIIKNFYNEI

SEQ ID NO: 3387743 - protein, 17 aa, Plasmodium falciparum
KYNNLFCTKSNNTSNHN

SEQ ID NO: 3387744 - protein, 24 aa, Plasmodium falciparum
KYNNTPYYNYYYYYYDDDDDRKKE

SEQ ID NO: 3387745 - protein, 17 aa, Plasmodium falciparum
KYNVKLKNYVQNHNTQQ

SEQ ID NO: 3387746 - protein, 21 aa, Plasmodium falciparum
KYPDQLLFEHLNQKFITDAKF

SEQ ID NO: 3387747 - protein, 17 aa, Plasmodium falciparum
KYPEYYTVLFALSRSIG

SEQ ID NO: 3387748 - protein, 28 aa, Plasmodium falciparum
KYPKMASDIFFLTQKSSLPVQKKYSMFR

SEQ ID NO: 3387749 - protein, 22 aa, Plasmodium falciparum
KYPSRSHIFTERFSYHASDEHN

SEQ ID NO: 3387750 - protein, 26 aa, Plasmodium falciparum
KYQDKPDFFYIIKKGIVTVKTDFKED

SEQ ID NO: 3387751 - protein, 21 aa, Plasmodium falciparum
KYRKIIYSLSYLHCVLCERKK

SEQ ID NO: 3387752 - protein, 26 aa, Plasmodium falciparum
KYRNKEYFDFLKSIYYNDKNNIHNSD

SEQ ID NO: 3387753 - protein, 30 aa, Plasmodium falciparum
KYRVNFYRNVVYFVIMRRNKFHSNVLNQGE

SEQ ID NO: 3387754 - protein, 26 aa, Plasmodium falciparum
KYSCKLGFVSLFMYASTLALKKMPNV

SEQ ID NO: 3387755 - protein, 30 aa, Plasmodium falciparum
KYSCVYKQPNILIIHLIRLQEDGSKIDKPI

SEQ ID NO: 3387756 - protein, 23 aa, Plasmodium falciparum
KYSDWKFTCIPTLGFSKSSNRVQ

SEQ ID NO: 3387757 - protein, 20 aa, Plasmodium falciparum
KYSKILEDVLILIGNNYLSV

SEQ ID NO: 3387758 - protein, 19 aa, Plasmodium falciparum
KYSLFVKKDTCIISSACTS

SEQ ID NO: 3387759 - protein, 24 aa, Plasmodium falciparum
KYSLHLYIKINFILNHIRNISIVD

SEQ ID NO: 3387760 - protein, 25 aa, Plasmodium falciparum
KYSNDLFFHQNGFNNCSLYNEENKM

SEQ ID NO: 3387761 - protein, 30 aa, Plasmodium falciparum
KYSNKFLCNEYFYIPITNTNYFKNKSLLNK

SEQ ID NO: 3387762 - protein, 20 aa, Plasmodium falciparum
KYSNMFYISVSENYLLGEVI

SEQ ID NO: 3387763 - protein, 25 aa, Plasmodium falciparum
KYSYDLHFNMKTPVVVFPTGFYNNE

SEQ ID NO: 3387764 - protein, 23 aa, Plasmodium falciparum
KYSYKRKLLTLFSAKNYCNKYNN

SEQ ID NO: 3387765 - protein, 18 aa, Plasmodium falciparum
KYTDGFINNIITFLERFS

SEQ ID NO: 3387766 - protein, 28 aa, Plasmodium falciparum
KYTDNDNNLLLVLLNQKDNSNGNNMENN

SEQ ID NO: 3387767 - protein, 18 aa, Plasmodium falciparum
KYTFTCCYEYYCSLECFK

SEQ ID NO: 3387768 - protein, 31 aa, Plasmodium falciparum
KYTGIYHIYYYLFMPNMKFLNDIIFRISSLQ

SEQ ID NO: 3387769 - protein, 23 aa, Plasmodium falciparum
KYTHEVVTLWYRAPDVLMGSKKY

SEQ ID NO: 3387770 - protein, 36 aa, Plasmodium falciparum
KYTIDGCAIFYNKKKLKFVETYALEFSKLIKEASVL

SEQ ID NO: 3387771 - protein, 20 aa, Plasmodium falciparum
KYTLKYYITNLFRLKDLFNN

SEQ ID NO: 3387772 - protein, 32 aa, Plasmodium falciparum
KYTREKNIYVVYMIYNCLFERIEVKNIKVKNI

SEQ ID NO: 3387773 - protein, 20 aa, Plasmodium falciparum
KYVCLYLPEVYKNAIETQDE

SEQ ID NO: 3387774 - protein, 25 aa, Plasmodium falciparum
KYVCNHFIRVIKLNNITYNYKNKEE

SEQ ID NO: 3387775 - protein, 25 aa, Plasmodium falciparum
KYVDKPVVIPVSKTIKPVYKYEGKK

SEQ ID NO: 3387776 - protein, 24 aa, Plasmodium falciparum
KYVGCLLPYEFVSIYKTLKIIKRN

SEQ ID NO: 3387777 - protein, 23 aa, Plasmodium falciparum
KYVHLNCLRTWMRGRLNVRNDCS

SEQ ID NO: 3387778 - protein, 25 aa, Plasmodium falciparum
KYVLKIIYEHMKLGNFLINSNEFLN

SEQ ID NO: 3387779 - protein, 23 aa, Plasmodium falciparum
KYVMDLINKKVFLLIKKMKHIKK

SEQ ID NO: 3387780 - protein, 19 aa, Plasmodium falciparum
KYVNKKIKFLYSYSYYHFD

SEQ ID NO: 3387781 - protein, 42 aa, Plasmodium falciparum
KYVNKYVDVIKPIITYKTKHISKPIYLDKIKYQPKVVEKEKI

SEQ ID NO: 3387782 - protein, 23 aa, Plasmodium falciparum
KYVQETYSFTFDKSLFAAPKFHP

SEQ ID NO: 3387783 - protein, 20 aa, Plasmodium falciparum
KYVTNVKKILLTIGKKIYEE

SEQ ID NO: 3387784 - protein, 24 aa, Plasmodium falciparum
KYVWKPIEKIVYVQKLIPKFDVNL

SEQ ID NO: 3387785 - protein, 19 aa, Plasmodium falciparum
KYVYGKLYDLIKDLNNYNV

SEQ ID NO: 3387786 - protein, 32 aa, Plasmodium falciparum
KYYDTKEILAYLLPYHTYYLDEVRIASYEEDE

SEQ ID NO: 3387787 - protein, 19 aa, Plasmodium falciparum
KYYERSIVVNYKTLRRLIN

SEQ ID NO: 3387788 - protein, 19 aa, Plasmodium falciparum
KYYLYNWKCASCHPSKIGI

SEQ ID NO: 3387789 - protein, 19 aa, Plasmodium falciparum
KYYVYYFIKYDDSLKIDLY

SEQ ID NO: 3387790 - protein, 18 aa, Plasmodium falciparum
LACQSNVLEYLLLYKYGS

SEQ ID NO: 3387791 - protein, 26 aa, Plasmodium falciparum
LADEEPYVFFLYKSSNIFMPLGYLKI

SEQ ID NO: 3387792 - protein, 19 aa, Plasmodium falciparum
LAEFWMIEPEIAFADLYDN

SEQ ID NO: 3387793 - protein, 28 aa, Plasmodium falciparum
LAENHMFDRFFTFDTDLLSIEKQKRIFL

SEQ ID NO: 3387794 - protein, 19 aa, Plasmodium falciparum
LAENNNGLTILFVETKRKA

SEQ ID NO: 3387795 - protein, 27 aa, Plasmodium falciparum
LAHFKTYHFIFYILNFVHETKFPIFSD

SEQ ID NO: 3387796 - protein, 19 aa, Plasmodium falciparum
LAHINGVILFIIDISEQCG

SEQ ID NO: 3387797 - protein, 36 aa, Plasmodium falciparum
LAIKEYVLKTIYRKKNVDFLYEKLEFQQKDNLMVNR

SEQ ID NO: 3387798 - protein, 32 aa, Plasmodium falciparum
LAISFITEHDSHLFYDLKQFLISSNNIVPLEL

SEQ ID NO: 3387799 - protein, 21 aa, Plasmodium falciparum
LAKALKLYPGGTRNRWVLISN

SEQ ID NO: 3387800 - protein, 41 aa, Plasmodium falciparum
LAKDKKLLDDALLDCYGRFIALLPEFLLKDHVHLYFQIQEA

SEQ ID NO: 3387801 - protein, 24 aa, Plasmodium falciparum
LALKNRYEALFLLRDMETDTSLNA

SEQ ID NO: 3387802 - protein, 27 aa, Plasmodium falciparum
LALNDNFFKLVSWYDNEWGYSNRVLDL

SEQ ID NO: 3387803 - protein, 17 aa, Plasmodium falciparum
LALYLKDACLNLGKEKQ

SEQ ID NO: 3387804 - protein, 18 aa, Plasmodium falciparum
LAQTRLPSLKTLSIKCVR

SEQ ID NO: 3387805 - protein, 17 aa, Plasmodium falciparum
LARAEATHLMNCDFLFT

SEQ ID NO: 3387806 - protein, 19 aa, Plasmodium falciparum
LARQMMILNRILTGKQLSD

SEQ ID NO: 3387807 - protein, 17 aa, Plasmodium falciparum
LARSSSCLFMFNNIKRN

SEQ ID NO: 3387808 - protein, 25 aa, Plasmodium falciparum
LASHEPYFYILREIIDLDPKSEEKE

SEQ ID NO: 3387809 - protein, 24 aa, Plasmodium falciparum
LASTNFNPLIFWNAGIQVVALNYQ

SEQ ID NO: 3387810 - protein, 23 aa, Plasmodium falciparum
LATKIYAHFLNNILPKNKHLANV

SEQ ID NO: 3387811 - protein, 41 aa, Plasmodium falciparum
LATKPSYKYFYIPLAKFLGSFFPSLRLTPGLRFNMFPHMND

SEQ ID NO: 3387812 - protein, 19 aa, Plasmodium falciparum
LATPRLLEPILLTEIICSG

SEQ ID NO: 3387813 - protein, 18 aa, Plasmodium falciparum
LAVGYRHGPSPRLNFAYD

SEQ ID NO: 3387814 - protein, 23 aa, Plasmodium falciparum
LAVNAILRIKDNLNLDLIQIIKK

SEQ ID NO: 3387815 - protein, 17 aa, Plasmodium falciparum
LCEKTYLCYMHQGKFLY

SEQ ID NO: 3387816 - protein, 17 aa, Plasmodium falciparum
LCFFTLQCFTHSLRTKH

SEQ ID NO: 3387817 - protein, 23 aa, Plasmodium falciparum
LCGGHYFAYVKLNDQWYNFNDSC

SEQ ID NO: 3387818 - protein, 30 aa, Plasmodium falciparum
LCHKEEKIVILFFYLISHSSNIKTVYYIWN

SEQ ID NO: 3387819 - protein, 25 aa, Plasmodium falciparum
LCIDKKYIFPIFSGSALHSYGVHIL

SEQ ID NO: 3387820 - protein, 20 aa, Plasmodium falciparum
LCIILWSYTYATNIEKHDLY

SEQ ID NO: 3387821 - protein, 19 aa, Plasmodium falciparum
LCIPGKIENYISIIDCSGI

SEQ ID NO: 3387822 - protein, 31 aa, Plasmodium falciparum
LCIQIYNLINKFLFFLRFYISHTLNNNMDNN

SEQ ID NO: 3387823 - protein, 23 aa, Plasmodium falciparum
LCKKNIIAIHKDKYNLKPELLLE

SEQ ID NO: 3387824 - protein, 27 aa, Plasmodium falciparum
LCKLKRSITCLFILKPDIHILTFEQTI

SEQ ID NO: 3387825 - protein, 18 aa, Plasmodium falciparum
LCKNIHIHKILCTVLKSN

SEQ ID NO: 3387826 - protein, 24 aa, Plasmodium falciparum
LCMMRTFHFNIYKNVKFSNYITKA

SEQ ID NO: 3387827 - protein, 27 aa, Plasmodium falciparum
LCNIKNLLLICKYLDIIEIYQVEKILK

SEQ ID NO: 3387828 - protein, 43 aa, Plasmodium falciparum
LCNSLKKQVIMKKKKLLLLIEKAKLQNFTYKNKDLQILLNVEK

SEQ ID NO: 3387829 - protein, 25 aa, Plasmodium falciparum
LCNTYKRGFIQVLLKHGMNSKGIQN

SEQ ID NO: 3387830 - protein, 21 aa, Plasmodium falciparum
LCNWLFLDKYILEENVIDLYF

SEQ ID NO: 3387831 - protein, 17 aa, Plasmodium falciparum
LCQDPKVLFAAYRQPHP

SEQ ID NO: 3387832 - protein, 17 aa, Plasmodium falciparum
LCRACGRHILKQKFATE

SEQ ID NO: 3387833 - protein, 26 aa, Plasmodium falciparum
LCSASYERFIIILNTETRKVIKRIHV

SEQ ID NO: 3387834 - protein, 22 aa, Plasmodium falciparum
LCSLNICECCCLVVDVVDGCMY

SEQ ID NO: 3387835 - protein, 17 aa, Plasmodium falciparum
LCSTFFDYIKKKNIIHF

SEQ ID NO: 3387836 - protein, 25 aa, Plasmodium falciparum
LCSTNTYFFIIKFDDLNNDYQIIKS

SEQ ID NO: 3387837 - protein, 19 aa, Plasmodium falciparum
LCTNFFAFLSHEPCYMCAM

SEQ ID NO: 3387838 - protein, 34 aa, Plasmodium falciparum
LCTSPASLLSLYYLSEHILQFQKGTIKYILQDLR

SEQ ID NO: 3387839 - protein, 17 aa, Plasmodium falciparum
LCVCVEDDRKKYVTKEK

SEQ ID NO: 3387840 - protein, 26 aa, Plasmodium falciparum
LCVNNSNELYLYNKSITICDNNNNIL

SEQ ID NO: 3387841 - protein, 18 aa, Plasmodium falciparum
LCWKFLTVAIVLLDTALR

SEQ ID NO: 3387842 - protein, 17 aa, Plasmodium falciparum
LDALFKNKFLEIFQNIQ

SEQ ID NO: 3387843 - protein, 18 aa, Plasmodium falciparum
LDALKKDKYFNCLRCKYI

SEQ ID NO: 3387844 - protein, 23 aa, Plasmodium falciparum
LDDNVLYNNIILNFLNKLNIEEE

SEQ ID NO: 3387845 - protein, 24 aa, Plasmodium falciparum
LDDPFVCLNFLVSKGLLQGNNNTN

SEQ ID NO: 3387846 - protein, 19 aa, Plasmodium falciparum
LDEADRMLDMGFSPQIRSI

SEQ ID NO: 3387847 - protein, 21 aa, Plasmodium falciparum
LDEFFIMNKIVEVRKERIINI

SEQ ID NO: 3387848 - protein, 19 aa, Plasmodium falciparum
LDEFQTYYEPRLFHSRINV

SEQ ID NO: 3387849 - protein, 23 aa, Plasmodium falciparum
LDENDFLKLLLEFNKKGIHFFNI

SEQ ID NO: 3387850 - protein, 32 aa, Plasmodium falciparum
LDENMYIHFTVFLIYYEFNIIETILDFAESQC

SEQ ID NO: 3387851 - protein, 19 aa, Plasmodium falciparum
LDESIIFSLYIQKYFYCAN

SEQ ID NO: 3387852 - protein, 23 aa, Plasmodium falciparum
LDESYSYSLIKLLKDSSICAESD

SEQ ID NO: 3387853 - protein, 29 aa, Plasmodium falciparum
LDGELYLGYDISVFILLVKAEHFEYCRRI

SEQ ID NO: 3387854 - protein, 17 aa, Plasmodium falciparum
LDGSRPIPIDKITYELS

SEQ ID NO: 3387855 - protein, 25 aa, Plasmodium falciparum
LDIAWELLRIFPEDMLKKIKTDILS

SEQ ID NO: 3387856 - protein, 24 aa, Plasmodium falciparum
LDIDNIPCNILNNLFAYNIVKNCS

SEQ ID NO: 3387857 - protein, 24 aa, Plasmodium falciparum
LDIISIAIYVALKDTFFPIVKPKK

SEQ ID NO: 3387858 - protein, 24 aa, Plasmodium falciparum
LDIKKYISIIYKRKKHMNIIMKRK

SEQ ID NO: 3387859 - protein, 21 aa, Plasmodium falciparum
LDILGVLIKYHPTQFLNTCCE

SEQ ID NO: 3387860 - protein, 18 aa, Plasmodium falciparum
LDIMKWICKIPGKKGGLW

SEQ ID NO: 3387861 - protein, 22 aa, Plasmodium falciparum
LDINKLLETLIRFINSEYNSIY

SEQ ID NO: 3387862 - protein, 25 aa, Plasmodium falciparum
LDITSTEYYYLKKTELFGISESREK

SEQ ID NO: 3387863 - protein, 19 aa, Plasmodium falciparum
LDIWDYYRNNAISSFDYNN

SEQ ID NO: 3387864 - protein, 25 aa, Plasmodium falciparum
LDKMALLPYADIIIDILLQKLNSSN

SEQ ID NO: 3387865 - protein, 30 aa, Plasmodium falciparum
LDKNFNFYSFFLPITYLQYQKYIMGQDFIA

SEQ ID NO: 3387866 - protein, 25 aa, Plasmodium falciparum
LDKQKYFQTLKMKDLKKKFLFSINN

SEQ ID NO: 3387867 - protein, 26 aa, Plasmodium falciparum
LDKSRNSFIGFWNFPVSKGISEQIWY

SEQ ID NO: 3387868 - protein, 42 aa, Plasmodium falciparum
LDKYIKYHGPINELLALCWIKQILLGLLYMKNLPTGKVHHCD

SEQ ID NO: 3387869 - protein, 25 aa, Plasmodium falciparum
LDLECIFSKLLLLKKKKYACAKVID

SEQ ID NO: 3387870 - protein, 17 aa, Plasmodium falciparum
LDLLKQKGIPVVMRINP

SEQ ID NO: 3387871 - protein, 24 aa, Plasmodium falciparum
LDLRVIEPIIFFNTSFIHSNNLIV

SEQ ID NO: 3387872 - protein, 20 aa, Plasmodium falciparum
LDLVKIFYNFEKHKNSHFFQ

SEQ ID NO: 3387873 - protein, 17 aa, Plasmodium falciparum
LDMGFEKQLRKIMTQVN

SEQ ID NO: 3387874 - protein, 24 aa, Plasmodium falciparum
LDMKMHSNIYLYDLFKKTNKESND

SEQ ID NO: 3387875 - protein, 24 aa, Plasmodium falciparum
LDNAKLLIASFREILSKDIYDKFF

SEQ ID NO: 3387876 - protein, 26 aa, Plasmodium falciparum
LDNDCKTFYLLNPDGILDSVAGLENL

SEQ ID NO: 3387877 - protein, 42 aa, Plasmodium falciparum
LDNDKITLIQFKSVIHKYDFFLYIFFNCLHEDIWGLQGNVLY

SEQ ID NO: 3387878 - protein, 22 aa, Plasmodium falciparum
LDNFQKLLYVPLKDINIYIGEF

SEQ ID NO: 3387879 - protein, 21 aa, Plasmodium falciparum
LDNIIIDFNKLKENCITKEKK

SEQ ID NO: 3387880 - protein, 24 aa, Plasmodium falciparum
LDNIKNIYKYDKYSNYINTVKNKK

SEQ ID NO: 3387881 - protein, 18 aa, Plasmodium falciparum
LDNLSVLVVIFQNPDKNN

SEQ ID NO: 3387882 - protein, 29 aa, Plasmodium falciparum
LDNNNLCLHITLADLLFIHNHQKKNYNFV

SEQ ID NO: 3387883 - protein, 18 aa, Plasmodium falciparum
LDNWLQMDINDFEKYLLR

SEQ ID NO: 3387884 - protein, 20 aa, Plasmodium falciparum
LDNYDNNIFYMNKIKNTNNN

SEQ ID NO: 3387885 - protein, 23 aa, Plasmodium falciparum
LDQEFYKMKMLEKEKKSLSIHVK

SEQ ID NO: 3387886 - protein, 26 aa, Plasmodium falciparum
LDQKKRSFPRFYFLSNKEILEILGMY

SEQ ID NO: 3387887 - protein, 31 aa, Plasmodium falciparum
LDQNDDVMLGFYNTPLLVPNPAIHHCILLND

SEQ ID NO: 3387888 - protein, 24 aa, Plasmodium falciparum
LDQYEFVILPSLKYINISNTNIAL

SEQ ID NO: 3387889 - protein, 20 aa, Plasmodium falciparum
LDQYYYDLNGLVKIFLKNKK

SEQ ID NO: 3387890 - protein, 25 aa, Plasmodium falciparum
LDSFTCEYFCFSVCVKNEFNTYLEF

SEQ ID NO: 3387891 - protein, 20 aa, Plasmodium falciparum
LDSICLITYSFLKCGKNKEL

SEQ ID NO: 3387892 - protein, 27 aa, Plasmodium falciparum
LDSKRKSFPRFFFISSTDLIDILSNGN

SEQ ID NO: 3387893 - protein, 21 aa, Plasmodium falciparum
LDTFINLKCLFLNNNCIKKID

SEQ ID NO: 3387894 - protein, 24 aa, Plasmodium falciparum
LDTKQLHIEILAPTYNQIQIARNE

SEQ ID NO: 3387895 - protein, 20 aa, Plasmodium falciparum
LDTQLFSYKSHKYLSSVHDN

SEQ ID NO: 3387896 - protein, 26 aa, Plasmodium falciparum
LDTSFSTLRFALKCKTIKKKIEVNYL

SEQ ID NO: 3387897 - protein, 25 aa, Plasmodium falciparum
LDTYIKLFCLAGNFIQDHIKDDFIY

SEQ ID NO: 3387898 - protein, 22 aa, Plasmodium falciparum
LDVDHMYLCKSHFYVSLKHNIS

SEQ ID NO: 3387899 - protein, 17 aa, Plasmodium falciparum
LDVLRIINEPTAAALAF

SEQ ID NO: 3387900 - protein, 24 aa, Plasmodium falciparum
LDVSEPLILLKTQLWQLTNVPPEK

SEQ ID NO: 3387901 - protein, 35 aa, Plasmodium falciparum
LDYAFTLILNLKKTFRFLFFYTKLSIEDKFMEYTI

SEQ ID NO: 3387902 - protein, 19 aa, Plasmodium falciparum
LDYDEIYFLYLRCVNDKKK

SEQ ID NO: 3387903 - protein, 17 aa, Plasmodium falciparum
LEAACELAMWKEASNIA

SEQ ID NO: 3387904 - protein, 18 aa, Plasmodium falciparum
LEALKYCLPEPLRHVHKT

SEQ ID NO: 3387905 - protein, 19 aa, Plasmodium falciparum
LEALSLLLKYDITNAEIGF

SEQ ID NO: 3387906 - protein, 23 aa, Plasmodium falciparum
LEASLFVEFLSPFMDMLNIINDI

SEQ ID NO: 3387907 - protein, 26 aa, Plasmodium falciparum
LEDCDIILEKLIELNLDYPSITYLNV

SEQ ID NO: 3387908 - protein, 24 aa, Plasmodium falciparum
LEDDIKIIISKYYKLLFDYNCLGG

SEQ ID NO: 3387909 - protein, 26 aa, Plasmodium falciparum
LEDEKKFFEFFFKNVQMYNTHLPMEK

SEQ ID NO: 3387910 - protein, 29 aa, Plasmodium falciparum
LEDIDVLPYREELALIENMLAYLKKLQEE

SEQ ID NO: 3387911 - protein, 25 aa, Plasmodium falciparum
LEDIKVKHFALLKDKYKKNITDKNN

SEQ ID NO: 3387912 - protein, 24 aa, Plasmodium falciparum
LEDIYFRIRHSVLFFHKDIQGLKD

SEQ ID NO: 3387913 - protein, 27 aa, Plasmodium falciparum
LEEAKNFYNFLRPVFKRNAKWSAIKPV

SEQ ID NO: 3387914 - protein, 19 aa, Plasmodium falciparum
LEEEDFYRAIFYRSKTKFD

SEQ ID NO: 3387915 - protein, 26 aa, Plasmodium falciparum
LEEEKKEFKLYLEQKYKENFENEKSG

SEQ ID NO: 3387916 - protein, 26 aa, Plasmodium falciparum
LEEFCKAFYYIILNEILKTLTDSFHK

SEQ ID NO: 3387917 - protein, 19 aa, Plasmodium falciparum
LEEFYINNYPQHVRLKISH

SEQ ID NO: 3387918 - protein, 22 aa, Plasmodium falciparum
LEEGYFLYDVKSIHLFKKGKKK

SEQ ID NO: 3387919 - protein, 32 aa, Plasmodium falciparum
LEEIHKKYIIYQLLRALKYIHSGGLLHRDIKP

SEQ ID NO: 3387920 - protein, 31 aa, Plasmodium falciparum
LEEIKCLYFFFLINILRFKNNLDLNVIRSIC

SEQ ID NO: 3387921 - protein, 18 aa, Plasmodium falciparum
LEEKLKALNLLKEPFKNL

SEQ ID NO: 3387922 - protein, 18 aa, Plasmodium falciparum
LEESSFKVLFPKYREKYL

SEQ ID NO: 3387923 - protein, 17 aa, Plasmodium falciparum
LEFFPWLDDIFNLMYLN

SEQ ID NO: 3387924 - protein, 21 aa, Plasmodium falciparum
LEFINILICCNYIEKINICIT

SEQ ID NO: 3387925 - protein, 18 aa, Plasmodium falciparum
LEFSINRITLGKVYFELF

SEQ ID NO: 3387926 - protein, 25 aa, Plasmodium falciparum
LEGINKIFFLEKNKVLLYKIQTKLR

SEQ ID NO: 3387927 - protein, 28 aa, Plasmodium falciparum
LEGLTVYKVLFSLPENILENTLKLCREK

SEQ ID NO: 3387928 - protein, 23 aa, Plasmodium falciparum
LEHCFKYNLFEEYNYPHIHTGKN

SEQ ID NO: 3387929 - protein, 23 aa, Plasmodium falciparum
LEHENILKIWSFFNNFKDDIFHT

SEQ ID NO: 3387930 - protein, 20 aa, Plasmodium falciparum
LEHILLKYTTGINNYFDYIE

SEQ ID NO: 3387931 - protein, 20 aa, Plasmodium falciparum
LEHINFPMMETQPNTPHIFN

SEQ ID NO: 3387932 - protein, 20 aa, Plasmodium falciparum
LEHLIFLGSHKYPYKGLLDF

SEQ ID NO: 3387933 - protein, 18 aa, Plasmodium falciparum
LEHSLPYQVKKKIKTMKI

SEQ ID NO: 3387934 - protein, 18 aa, Plasmodium falciparum
LEHTLFKGTFFPTWEGLF

SEQ ID NO: 3387935 - protein, 20 aa, Plasmodium falciparum
LEHYPTYYNLYEECKQFYMK

SEQ ID NO: 3387936 - protein, 20 aa, Plasmodium falciparum
LEIDMKIYLLTKNIDIERTR

SEQ ID NO: 3387937 - protein, 24 aa, Plasmodium falciparum
LEIGAVELLILYEGLDIIRLTTKN

SEQ ID NO: 3387938 - protein, 29 aa, Plasmodium falciparum
LEIIINNRFFIIILIPLNTPIKTDCILNL

SEQ ID NO: 3387939 - protein, 18 aa, Plasmodium falciparum
LEILIKILSKIFLKGNYS

SEQ ID NO: 3387940 - protein, 22 aa, Plasmodium falciparum
LEILNIPYMKNMKDKELDAIEQ

SEQ ID NO: 3387941 - protein, 32 aa, Plasmodium falciparum
LEKALELSPLFPEIWFILGCSYMKIQNFDESI

SEQ ID NO: 3387942 - protein, 17 aa, Plasmodium falciparum
LEKDGLKLPYNFDLLLD

SEQ ID NO: 3387943 - protein, 24 aa, Plasmodium falciparum
LEKDLNEYIFFSSKNKINLNEEHI

SEQ ID NO: 3387944 - protein, 25 aa, Plasmodium falciparum
LEKEEVLVLFFHSTLLDNNYIYELK

SEQ ID NO: 3387945 - protein, 17 aa, Plasmodium falciparum
LEKHKEFLLINKSNEDK

SEQ ID NO: 3387946 - protein, 22 aa, Plasmodium falciparum
LEKKEWYWTYEGIKFFYTKDEL

SEQ ID NO: 3387947 - protein, 22 aa, Plasmodium falciparum
LEKKFDFHIMFNGPLELSETRD

SEQ ID NO: 3387948 - protein, 24 aa, Plasmodium falciparum
LEKKKIYMRYFKKGIKDKIENMGN

SEQ ID NO: 3387949 - protein, 18 aa, Plasmodium falciparum
LEKKNIIAYPSFDQTFIE

SEQ ID NO: 3387950 - protein, 26 aa, Plasmodium falciparum
LEKKSMYLLHNYYNKNGKEKDDNNNN

SEQ ID NO: 3387951 - protein, 29 aa, Plasmodium falciparum
LEKNNIPTLLVLLLYRILIEKPENIIKFI

SEQ ID NO: 3387952 - protein, 29 aa, Plasmodium falciparum
LEKQPSDINPLFISLPYNIHMDEIAEYNK

SEQ ID NO: 3387953 - protein, 17 aa, Plasmodium falciparum
LEKRKMLLEKEKGIYDR

SEQ ID NO: 3387954 - protein, 23 aa, Plasmodium falciparum
LEKSYNELLIQLEKYKKELEEIK

SEQ ID NO: 3387955 - protein, 22 aa, Plasmodium falciparum
LEKTTIDNLYYNTPQQLYVILK

SEQ ID NO: 3387956 - protein, 24 aa, Plasmodium falciparum
LEKYNILNITLLKNIIEANKFEWM

SEQ ID NO: 3387957 - protein, 24 aa, Plasmodium falciparum
LEKYNKIIAFGKPSAMIYTKRASV

SEQ ID NO: 3387958 - protein, 26 aa, Plasmodium falciparum
LELARQEIPLFYFPLNNMYSESELRY

SEQ ID NO: 3387959 - protein, 25 aa, Plasmodium falciparum
LELEREKQLLRKKKLLLNCSIGNVK

SEQ ID NO: 3387960 - protein, 29 aa, Plasmodium falciparum
LELSDDKKEFFFYYLDLYEENYEKIKKEQ

SEQ ID NO: 3387961 - protein, 42 aa, Plasmodium falciparum
LELSYRLLVHDILFYAFFSYLSDLPFWAKPPIEILRIYNYES

SEQ ID NO: 3387962 - protein, 26 aa, Plasmodium falciparum
LELTNKFYHILLLNYIELKYKQYPFK

SEQ ID NO: 3387963 - protein, 18 aa, Plasmodium falciparum
LELTSGEIPLWVKQKYLL

SEQ ID NO: 3387964 - protein, 17 aa, Plasmodium falciparum
LELYPKLLNFKTVLTAS

SEQ ID NO: 3387965 - protein, 18 aa, Plasmodium falciparum
LEMYIQTRSYRSPEVLLQ

SEQ ID NO: 3387966 - protein, 17 aa, Plasmodium falciparum
LENCVHEWFPFLKDEHD

SEQ ID NO: 3387967 - protein, 27 aa, Plasmodium falciparum
LENEHIARIDVIGGGGFIPSIKINNNT

SEQ ID NO: 3387968 - protein, 27 aa, Plasmodium falciparum
LENHKRRIWSICWSPDGNYLASVGADK

SEQ ID NO: 3387969 - protein, 23 aa, Plasmodium falciparum
LENKALLCLIKKYEEKNKFLNVV

SEQ ID NO: 3387970 - protein, 23 aa, Plasmodium falciparum
LENKYLHYPNVFYTNDKINDKTL

SEQ ID NO: 3387971 - protein, 24 aa, Plasmodium falciparum
LENLIKLNVILISNEKYYQSEKWG

SEQ ID NO: 3387972 - protein, 18 aa, Plasmodium falciparum
LENLLKYFSKHNIKDGSY

SEQ ID NO: 3387973 - protein, 46 aa, Plasmodium falciparum
LENLLNDKWGSFKLFEKWIKDSSKWQWIDLKLQKEYINSNIELEKL

SEQ ID NO: 3387974 - protein, 25 aa, Plasmodium falciparum
LENLNPNFYLAKYSQLKKWHSNFNY

SEQ ID NO: 3387975 - protein, 24 aa, Plasmodium falciparum
LENMTGLEALRIWKYLLTNSEEKI

SEQ ID NO: 3387976 - protein, 23 aa, Plasmodium falciparum
LENPINIHRWRNLEGNDPTSFDL

SEQ ID NO: 3387977 - protein, 24 aa, Plasmodium falciparum
LENPNLLREFMRPEILQAGLQIEN

SEQ ID NO: 3387978 - protein, 27 aa, Plasmodium falciparum
LENPTDYFVLLIINNLLIHTPESVLYK

SEQ ID NO: 3387979 - protein, 19 aa, Plasmodium falciparum
LENQFTPLSLCLECEVLLK

SEQ ID NO: 3387980 - protein, 25 aa, Plasmodium falciparum
LENSPLFMEIYNKGKFDLKPTSQKE

SEQ ID NO: 3387981 - protein, 23 aa, Plasmodium falciparum
LENVDVMLLERIKKNYKMLIRND

SEQ ID NO: 3387982 - protein, 29 aa, Plasmodium falciparum
LENYEKLFDLLFLSIFKMNLTLHRLEIIL

SEQ ID NO: 3387983 - protein, 30 aa, Plasmodium falciparum
LENYLKDKILKIALLMDIFMAILDTSFYEE

SEQ ID NO: 3387984 - protein, 17 aa, Plasmodium falciparum
LEPALPKLDEKTRTEWI

SEQ ID NO: 3387985 - protein, 30 aa, Plasmodium falciparum
LEQASCEYFLSFDIPYTASITYGFNRGQIF

SEQ ID NO: 3387986 - protein, 24 aa, Plasmodium falciparum
LEQEKIVLFMKGTPEKPLCGFSAN

SEQ ID NO: 3387987 - protein, 25 aa, Plasmodium falciparum
LEQERLLVVEFFKYQKLPVEISVHF

SEQ ID NO: 3387988 - protein, 22 aa, Plasmodium falciparum
LERERINIILKELIISCNEKKE

SEQ ID NO: 3387989 - protein, 18 aa, Plasmodium falciparum
LERILPRLSHANSAVVLS

SEQ ID NO: 3387990 - protein, 33 aa, Plasmodium falciparum
LERISNKDLIRKIIELQYCVINLSDSMEILKSK

SEQ ID NO: 3387991 - protein, 19 aa, Plasmodium falciparum
LERLSVDYGKKSKLNFCCW

SEQ ID NO: 3387992 - protein, 20 aa, Plasmodium falciparum
LERPLVVDHILNYRLPKKYL

SEQ ID NO: 3387993 - protein, 24 aa, Plasmodium falciparum
LERQKEMLYKFDFQTQVLTKKINM

SEQ ID NO: 3387994 - protein, 24 aa, Plasmodium falciparum
LESPRYYSPLKWYYGESIEKSYKN

SEQ ID NO: 3387995 - protein, 37 aa, Plasmodium falciparum
LETFKDIYLVDFILLDNPKPDLIRFFFSEINTPIIND

SEQ ID NO: 3387996 - protein, 39 aa, Plasmodium falciparum
LEVCSQRYMLLFLCPYGENFIRLLFTSLTYMNVHIKNNF

SEQ ID NO: 3387997 - protein, 18 aa, Plasmodium falciparum
LEYCIYKFKSDYAISYFD

SEQ ID NO: 3387998 - protein, 19 aa, Plasmodium falciparum
LEYGLPPTGGLGLGIDRIT

SEQ ID NO: 3387999 - protein, 23 aa, Plasmodium falciparum
LEYIALNSFNLQKKYWGCLISNV

SEQ ID NO: 3388000 - protein, 19 aa, Plasmodium falciparum
LEYILIHFTRQAIIKQFVW

SEQ ID NO: 3388001 - protein, 33 aa, Plasmodium falciparum
LEYSEQDIIKLIYYFMENFIFKKKKENRQMNGK

SEQ ID NO: 3388002 - protein, 30 aa, Plasmodium falciparum
LEYYFKKNEIMLLKNILKYIIQLMSEIKHQ

SEQ ID NO: 3388003 - protein, 18 aa, Plasmodium falciparum
LFAIPHPFSIANDAYNCL

SEQ ID NO: 3388004 - protein, 19 aa, Plasmodium falciparum
LFCECLIDFIKKKRVFFVN

SEQ ID NO: 3388005 - protein, 34 aa, Plasmodium falciparum
LFCIQHKKILNKDELYLILFKYMEDNKTEGTTII

SEQ ID NO: 3388006 - protein, 18 aa, Plasmodium falciparum
LFCLFMLRDIKKQNHMSV

SEQ ID NO: 3388007 - protein, 18 aa, Plasmodium falciparum
LFCLLKDVVRKRADFKLI

SEQ ID NO: 3388008 - protein, 34 aa, Plasmodium falciparum
LFCLSKYVYVQKKILFYLEHLLNFDNYNFKSKKK

SEQ ID NO: 3388009 - protein, 19 aa, Plasmodium falciparum
LFCNNYSNGFLLNEEYTKG

SEQ ID NO: 3388010 - protein, 22 aa, Plasmodium falciparum
LFDELNFYTCGLLLSLYESRIV

SEQ ID NO: 3388011 - protein, 24 aa, Plasmodium falciparum
LFDKMEGFITCNIVKSKKVILQKD

SEQ ID NO: 3388012 - protein, 17 aa, Plasmodium falciparum
LFDKYIISLFEKENYIK

SEQ ID NO: 3388013 - protein, 17 aa, Plasmodium falciparum
LFDMEILIENLKLFVNM

SEQ ID NO: 3388014 - protein, 17 aa, Plasmodium falciparum
LFEFNLYNNVQVAETLF

SEQ ID NO: 3388015 - protein, 17 aa, Plasmodium falciparum
LFEISKIKDYNLITHYE

SEQ ID NO: 3388016 - protein, 23 aa, Plasmodium falciparum
LFENIKENGFYIGTPTTGQHINP

SEQ ID NO: 3388017 - protein, 17 aa, Plasmodium falciparum
LFEYIHEISRKLLKTLD

SEQ ID NO: 3388018 - protein, 17 aa, Plasmodium falciparum
LFFLFSGHGSQEKDHNH

SEQ ID NO: 3388019 - protein, 26 aa, Plasmodium falciparum
LFFLFTKFFHCYKISYVLKNAKLAPN

SEQ ID NO: 3388020 - protein, 17 aa, Plasmodium falciparum
LFFNNLINTIKEKCIII

SEQ ID NO: 3388021 - protein, 18 aa, Plasmodium falciparum
LFFYIIKSLFVNTKAPET

SEQ ID NO: 3388022 - protein, 18 aa, Plasmodium falciparum
LFHANNKKVIFFKDKNKI

SEQ ID NO: 3388023 - protein, 18 aa, Plasmodium falciparum
LFHPLTYMHSILNEKLSR

SEQ ID NO: 3388024 - protein, 19 aa, Plasmodium falciparum
LFHQSNINELKLPPIMPPI

SEQ ID NO: 3388025 - protein, 17 aa, Plasmodium falciparum
LFHYIKYINNDNKIVEL

SEQ ID NO: 3388026 - protein, 20 aa, Plasmodium falciparum
LFIEHELLETAILFDDLWET

SEQ ID NO: 3388027 - protein, 38 aa, Plasmodium falciparum
LFIIEKNVDFYKNNFLPFFYIPCNYLFIKNYCNDNERC

SEQ ID NO: 3388028 - protein, 18 aa, Plasmodium falciparum
LFKDFWDRYIKCIKILKN

SEQ ID NO: 3388029 - protein, 23 aa, Plasmodium falciparum
LFKELYYFDESINSLYYIIKDHI

SEQ ID NO: 3388030 - protein, 18 aa, Plasmodium falciparum
LFKILTNKYNFVLKEKEN

SEQ ID NO: 3388031 - protein, 23 aa, Plasmodium falciparum
LFKKDRLYKYFKNFQQYVNSVEE

SEQ ID NO: 3388032 - protein, 22 aa, Plasmodium falciparum
LFKKWSYEEINIADLSLVDCIA

SEQ ID NO: 3388033 - protein, 19 aa, Plasmodium falciparum
LFKNYAGFVEARIIPQRNV

SEQ ID NO: 3388034 - protein, 36 aa, Plasmodium falciparum
LFKQNIGINYEYYYEQFLFILNKIILNISSNNNIHY

SEQ ID NO: 3388035 - protein, 18 aa, Plasmodium falciparum
LFLGAPNKEKIKLEENLK

SEQ ID NO: 3388036 - protein, 17 aa, Plasmodium falciparum
LFLTKRCFFLVHNNIYR

SEQ ID NO: 3388037 - protein, 20 aa, Plasmodium falciparum
LFNEYYFYRYLCCAYDFEKT

SEQ ID NO: 3388038 - protein, 20 aa, Plasmodium falciparum
LFNHEIYKLLFIFNKYLNNN

SEQ ID NO: 3388039 - protein, 32 aa, Plasmodium falciparum
LFNKHCYPQFFNSNFFFVIKKHSTIQSTMSEQ

SEQ ID NO: 3388040 - protein, 24 aa, Plasmodium falciparum
LFNKYNILDIFDYSNLYKIQDFLN

SEQ ID NO: 3388041 - protein, 22 aa, Plasmodium falciparum
LFNLDSLYYRLRNIFPHMEVIG

SEQ ID NO: 3388042 - protein, 17 aa, Plasmodium falciparum
LFNNDIMFSFAENDLQN

SEQ ID NO: 3388043 - protein, 17 aa, Plasmodium falciparum
LFNNRYTRNHHDNNSVN

SEQ ID NO: 3388044 - protein, 21 aa, Plasmodium falciparum
LFNTKRWKFNFSKGKNLFNNK

SEQ ID NO: 3388045 - protein, 19 aa, Plasmodium falciparum
LFPQKSWKGILFGDKNKHH

SEQ ID NO: 3388046 - protein, 26 aa, Plasmodium falciparum
LFQKNPYICFLLYIHDDFIFTNNSEY

SEQ ID NO: 3388047 - protein, 17 aa, Plasmodium falciparum
LFRACRQHYLKKISTYV

SEQ ID NO: 3388048 - protein, 18 aa, Plasmodium falciparum
LFRELQLRGFDRSALSKA

SEQ ID NO: 3388049 - protein, 17 aa, Plasmodium falciparum
LFRKKFANPILIGRDKD

SEQ ID NO: 3388050 - protein, 17 aa, Plasmodium falciparum
LFSCQLGTPLSSLQVLL

SEQ ID NO: 3388051 - protein, 27 aa, Plasmodium falciparum
LFSDSYVISFYTYRYYMYELVKNNRTI

SEQ ID NO: 3388052 - protein, 20 aa, Plasmodium falciparum
LFSHLFACIAILSFKNDTII

SEQ ID NO: 3388053 - protein, 26 aa, Plasmodium falciparum
LFSHPKYKLPILIKGNIHFDSTENMY

SEQ ID NO: 3388054 - protein, 21 aa, Plasmodium falciparum
LFSITHDFINLKNSNIIIIRR

SEQ ID NO: 3388055 - protein, 40 aa, Plasmodium falciparum
LFSSDHMFYLRKENFYFFYTFYFELFINSYLYNRYVCLKK

SEQ ID NO: 3388056 - protein, 18 aa, Plasmodium falciparum
LFTEIFHGIIKYCNKLYP

SEQ ID NO: 3388057 - protein, 25 aa, Plasmodium falciparum
LFTFAKDFCVIWNLFQGINKNVSYT

SEQ ID NO: 3388058 - protein, 55 aa, Plasmodium falciparum
LFTNKYIQTPYYYMLSIRYFVPRFFILFEKNYYADFYLILFLHNEFTSLGGRDVT

SEQ ID NO: 3388059 - protein, 21 aa, Plasmodium falciparum
LFYEGYLIYSSLEMNDIKIIY

SEQ ID NO: 3388060 - protein, 18 aa, Plasmodium falciparum
LFYSLTIFQILQGYPKGT

SEQ ID NO: 3388061 - protein, 34 aa, Plasmodium falciparum
LGCDWDNISSVDIFYLFESYYNFEKRKKKNIDYS

SEQ ID NO: 3388062 - protein, 36 aa, Plasmodium falciparum
LGDIIHLVQLAIHKGIFVYSQRILLPVSACEKSADD

SEQ ID NO: 3388063 - protein, 17 aa, Plasmodium falciparum
LGDTFQKLFSPPESLIC

SEQ ID NO: 3388064 - protein, 29 aa, Plasmodium falciparum
LGEEKVEFLLLLNLVYYINDIIIRKHCEK

SEQ ID NO: 3388065 - protein, 33 aa, Plasmodium falciparum
LGGPNQKYMCLNDWIYFIMNYEDMTTNRSIEFW

SEQ ID NO: 3388066 - protein, 26 aa, Plasmodium falciparum
LGGYLIQLYAKLYPSKVESLILCNSY

SEQ ID NO: 3388067 - protein, 25 aa, Plasmodium falciparum
LGHVNECFLFKLYSINSKSILISRL

SEQ ID NO: 3388068 - protein, 18 aa, Plasmodium falciparum
LGIDSYIFARGNRILRKF

SEQ ID NO: 3388069 - protein, 17 aa, Plasmodium falciparum
LGILNKYENEINSCINM

SEQ ID NO: 3388070 - protein, 22 aa, Plasmodium falciparum
LGINDFLHFDFMDSPSVETLIH

SEQ ID NO: 3388071 - protein, 27 aa, Plasmodium falciparum
LGITIYEIVLCTLPWKRNQSFENYIKT

SEQ ID NO: 3388072 - protein, 26 aa, Plasmodium falciparum
LGKERRKDIFLLYNNRNKEYERRILK

SEQ ID NO: 3388073 - protein, 32 aa, Plasmodium falciparum
LGKGLKINRKYLPLAYILGLDNVKISFSGSNK

SEQ ID NO: 3388074 - protein, 30 aa, Plasmodium falciparum
LGKINNEKYWFIFNDTINIEYKLYLEREEE

SEQ ID NO: 3388075 - protein, 23 aa, Plasmodium falciparum
LGKKYSYEISLRKYYDMIKCRRN

SEQ ID NO: 3388076 - protein, 23 aa, Plasmodium falciparum
LGKLKLLIIHLSSVNPLICIGQK

SEQ ID NO: 3388077 - protein, 24 aa, Plasmodium falciparum
LGLNEKLLRGIYSYGFEKPSAIQQ

SEQ ID NO: 3388078 - protein, 25 aa, Plasmodium falciparum
LGMEISPEKVFLAQKLMISKCNLQG

SEQ ID NO: 3388079 - protein, 27 aa, Plasmodium falciparum
LGNIPYIKFVLYYYKYNIYVPHQIHYE

SEQ ID NO: 3388080 - protein, 29 aa, Plasmodium falciparum
LGNQCKPFLKPIYLSIFRLFEIRTDICED

SEQ ID NO: 3388081 - protein, 32 aa, Plasmodium falciparum
LGQTRHFMALKTLIDLNIVEPYPPLCDIKNSF

SEQ ID NO: 3388082 - protein, 26 aa, Plasmodium falciparum
LGTRFFTDLIKFFPLNNLDKCSLCNN

SEQ ID NO: 3388083 - protein, 27 aa, Plasmodium falciparum
LGTTCGYLVFIFISEHFYNLVNDLLTN

SEQ ID NO: 3388084 - protein, 17 aa, Plasmodium falciparum
LGVKPPRGVLLYGPPGS

SEQ ID NO: 3388085 - protein, 20 aa, Plasmodium falciparum
LGYRLLNSITLLGQLFQTKK

SEQ ID NO: 3388086 - protein, 21 aa, Plasmodium falciparum
LGYYLKPRWYKNSPIHRIVTD

SEQ ID NO: 3388087 - protein, 31 aa, Plasmodium falciparum
LHCRSDFHVYNVKRKYKKLPPISLEEYREID

SEQ ID NO: 3388088 - protein, 26 aa, Plasmodium falciparum
LHDFPYHLYWFGLRPNLRDMFNDNNY

SEQ ID NO: 3388089 - protein, 18 aa, Plasmodium falciparum
LHDIYRLDRTFKLRKKNK

SEQ ID NO: 3388090 - protein, 17 aa, Plasmodium falciparum
LHDLNNISYEYFYKDTY

SEQ ID NO: 3388091 - protein, 22 aa, Plasmodium falciparum
LHEDIWGLQGNVLYGRDYISNF

SEQ ID NO: 3388092 - protein, 17 aa, Plasmodium falciparum
LHELSNFFLIDKTKREK

SEQ ID NO: 3388093 - protein, 19 aa, Plasmodium falciparum
LHENDIIKLGRFRLKVRQF

SEQ ID NO: 3388094 - protein, 17 aa, Plasmodium falciparum
LHERTCKINEFITVCTI

SEQ ID NO: 3388095 - protein, 21 aa, Plasmodium falciparum
LHEWLNNFTLSRKIKNVNRDF

SEQ ID NO: 3388096 - protein, 28 aa, Plasmodium falciparum
LHFFAYESRIFYFHNSLSLFNYFPLINN

SEQ ID NO: 3388097 - protein, 19 aa, Plasmodium falciparum
LHFGSFLVIKTYDGNIYKG

SEQ ID NO: 3388098 - protein, 20 aa, Plasmodium falciparum
LHFLSYLKKIHIYYSPQRCE

SEQ ID NO: 3388099 - protein, 26 aa, Plasmodium falciparum
LHGKRTLCETLGPLIVKFAIGELEKY

SEQ ID NO: 3388100 - protein, 24 aa, Plasmodium falciparum
LHHLKLVDTFFLQRSYIDSAIIVH

SEQ ID NO: 3388101 - protein, 26 aa, Plasmodium falciparum
LHIIQDMYTHWPFCTSFFNLISMVMA

SEQ ID NO: 3388102 - protein, 19 aa, Plasmodium falciparum
LHISSNNPYFFNLPSTNMD

SEQ ID NO: 3388103 - protein, 36 aa, Plasmodium falciparum
LHISTISSYRHTYLKTIYIWYKKNKKLLFNTDDNKE

SEQ ID NO: 3388104 - protein, 19 aa, Plasmodium falciparum
LHKFIIFETFRNKNKHLTN

SEQ ID NO: 3388105 - protein, 20 aa, Plasmodium falciparum
LHKINKCIHILLSNNNFAYA

SEQ ID NO: 3388106 - protein, 19 aa, Plasmodium falciparum
LHKIYINHKIKHLQFLGWN

SEQ ID NO: 3388107 - protein, 25 aa, Plasmodium falciparum
LHLMKKLPFKTIYLHAMIRDSRGEK

SEQ ID NO: 3388108 - protein, 20 aa, Plasmodium falciparum
LHLMQYVLTIFYEIIRNDGS

SEQ ID NO: 3388109 - protein, 17 aa, Plasmodium falciparum
LHMYNLETYTRIFIYNC

SEQ ID NO: 3388110 - protein, 26 aa, Plasmodium falciparum
LHNEKIYLEKLLNEKLNYIKDIEKKL

SEQ ID NO: 3388111 - protein, 27 aa, Plasmodium falciparum
LHNGDYAFTDFLLNNKIINSHNKEIIH

SEQ ID NO: 3388112 - protein, 17 aa, Plasmodium falciparum
LHNNFHNPYNIYDNIQN

SEQ ID NO: 3388113 - protein, 23 aa, Plasmodium falciparum
LHNRNFVYPLIPRGLGVDINDDR

SEQ ID NO: 3388114 - protein, 31 aa, Plasmodium falciparum
LHNVKSRIIIRILFLSFLRYSISNNNDTIKL

SEQ ID NO: 3388115 - protein, 32 aa, Plasmodium falciparum
LHNYIAVFGPCLSYNKLPSTWNISVCDYLKQQ

SEQ ID NO: 3388116 - protein, 19 aa, Plasmodium falciparum
LHQYFKRNMKFSIYGSLYV

SEQ ID NO: 3388117 - protein, 18 aa, Plasmodium falciparum
LHRLEIILKSAYQNLLQK

SEQ ID NO: 3388118 - protein, 21 aa, Plasmodium falciparum
LHSNIFLIDIFNKIKYGQKIC

SEQ ID NO: 3388119 - protein, 30 aa, Plasmodium falciparum
LHSPYITGNFYQLLKWKPLNLNTVDFGIET

SEQ ID NO: 3388120 - protein, 24 aa, Plasmodium falciparum
LHSYFSHSLLYLERLEDAIKNINI

SEQ ID NO: 3388121 - protein, 23 aa, Plasmodium falciparum
LHTIKKLIEDRLSYLRIVQDSAS

SEQ ID NO: 3388122 - protein, 23 aa, Plasmodium falciparum
LHVSNKLNLMCDYGSLCSAYILE

SEQ ID NO: 3388123 - protein, 26 aa, Plasmodium falciparum
LHYGKCTYFYILEKFQKRGLGIKIFN

SEQ ID NO: 3388124 - protein, 27 aa, Plasmodium falciparum
LHYINNKHNLLNSITLSNSLPQKNDYQ

SEQ ID NO: 3388125 - protein, 26 aa, Plasmodium falciparum
LHYKDMILLFEKYAEILEFRQKCLLC

SEQ ID NO: 3388126 - protein, 19 aa, Plasmodium falciparum
LIAFIINIVKLKFFDIYHH

SEQ ID NO: 3388127 - protein, 30 aa, Plasmodium falciparum
LIASNKFSFKRIGYLGLTILLDENTDILML

SEQ ID NO: 3388128 - protein, 21 aa, Plasmodium falciparum
LICLDFIHCDIHLKPKQLELR

SEQ ID NO: 3388129 - protein, 17 aa, Plasmodium falciparum
LICTDLYKPYNIMSDIN

SEQ ID NO: 3388130 - protein, 17 aa, Plasmodium falciparum
LICTKKFIEQNKGFDIT

SEQ ID NO: 3388131 - protein, 23 aa, Plasmodium falciparum
LIDHGFGKLIEEYFDRESKIYGM

SEQ ID NO: 3388132 - protein, 20 aa, Plasmodium falciparum
LIDLGYIEKKYEKAFTIASN

SEQ ID NO: 3388133 - protein, 29 aa, Plasmodium falciparum
LIDLKTKYVYCNVPWFNINVKYNIYAANF

SEQ ID NO: 3388134 - protein, 34 aa, Plasmodium falciparum
LIDPALMRPGRFDRIIYVPLPNYSSRFAILKKNL

SEQ ID NO: 3388135 - protein, 19 aa, Plasmodium falciparum
LIDQIIIKGNFKNLSLIVL

SEQ ID NO: 3388136 - protein, 35 aa, Plasmodium falciparum
LIDQLFCSLFPYFYFYELKLKILLFFIHKNDNQKE

SEQ ID NO: 3388137 - protein, 23 aa, Plasmodium falciparum
LIDRLHTVIRPYILRRLKKNVEK

SEQ ID NO: 3388138 - protein, 18 aa, Plasmodium falciparum
LIEENNELRRRLICSVCM

SEQ ID NO: 3388139 - protein, 20 aa, Plasmodium falciparum
LIEFVPEMKILISELNVILK

SEQ ID NO: 3388140 - protein, 17 aa, Plasmodium falciparum
LIEILDALEFNQVIIFV

SEQ ID NO: 3388141 - protein, 26 aa, Plasmodium falciparum
LIEKNFSKLYLYDCNYKKVIFYELLK

SEQ ID NO: 3388142 - protein, 23 aa, Plasmodium falciparum
LIEKPYLVYHNIIKMVPTDSKIT

SEQ ID NO: 3388143 - protein, 25 aa, Plasmodium falciparum
LIELDNKYLFLKKNKIILDIGCYPG

SEQ ID NO: 3388144 - protein, 18 aa, Plasmodium falciparum
LIERIKLKKNILRKKKEI

SEQ ID NO: 3388145 - protein, 23 aa, Plasmodium falciparum
LIERRTFSRIILTKDINFKKEKK

SEQ ID NO: 3388146 - protein, 17 aa, Plasmodium falciparum
LIFHKNLNYVSSKVKAK

SEQ ID NO: 3388147 - protein, 17 aa, Plasmodium falciparum
LIFLIPNEKNEFTHINK

SEQ ID NO: 3388148 - protein, 19 aa, Plasmodium falciparum
LIFRVTKRIFDILNKRKEE

SEQ ID NO: 3388149 - protein, 17 aa, Plasmodium falciparum
LIGIKNIYFCCLNERFG

SEQ ID NO: 3388150 - protein, 18 aa, Plasmodium falciparum
LIGINYYGTKYELNGCTN

SEQ ID NO: 3388151 - protein, 18 aa, Plasmodium falciparum
LIGKFSVEKYKSFLSKIE

SEQ ID NO: 3388152 - protein, 18 aa, Plasmodium falciparum
LIGLQTKVPHFKKLLKII

SEQ ID NO: 3388153 - protein, 18 aa, Plasmodium falciparum
LIHIQKLDKKENLTPSLI

SEQ ID NO: 3388154 - protein, 19 aa, Plasmodium falciparum
LIHPNILKVLDTYENEKRI

SEQ ID NO: 3388155 - protein, 19 aa, Plasmodium falciparum
LIICIDFLPKTLNVTCDII

SEQ ID NO: 3388156 - protein, 17 aa, Plasmodium falciparum
LIIHKNQAFLNPTNLIL

SEQ ID NO: 3388157 - protein, 17 aa, Plasmodium falciparum
LIIKGMNNYIYIYRISK

SEQ ID NO: 3388158 - protein, 18 aa, Plasmodium falciparum
LIILRKLKENVYNDIYGV

SEQ ID NO: 3388159 - protein, 26 aa, Plasmodium falciparum
LIKCVIIKNFIIFDVELWNIFLKKNI

SEQ ID NO: 3388160 - protein, 21 aa, Plasmodium falciparum
LIKEKNICKCLLLAGPSGSGK

SEQ ID NO: 3388161 - protein, 41 aa, Plasmodium falciparum
LIKETNRFFKMYNLHLKIEKLPINIPNDLKILMQKKKKIVD

SEQ ID NO: 3388162 - protein, 17 aa, Plasmodium falciparum
LIKIKRTRKNNYKFEFL

SEQ ID NO: 3388163 - protein, 19 aa, Plasmodium falciparum
LIKKLKNIFISRNIIYYRY

SEQ ID NO: 3388164 - protein, 31 aa, Plasmodium falciparum
LIKKMHKNILLGKWKNAIISLKKLNINKKLI

SEQ ID NO: 3388165 - protein, 17 aa, Plasmodium falciparum
LIKNNKLIRIPSFGHPK

SEQ ID NO: 3388166 - protein, 22 aa, Plasmodium falciparum
LIKNRWKIYYCTLLGQAQTEEE

SEQ ID NO: 3388167 - protein, 21 aa, Plasmodium falciparum
LIKQYVQIIFDPRLINADTSG

SEQ ID NO: 3388168 - protein, 20 aa, Plasmodium falciparum
LIKRNFHVSAFYALSKQSNQ

SEQ ID NO: 3388169 - protein, 27 aa, Plasmodium falciparum
LIKRRSSLMDFFKIKLKKKAPQAKKPK

SEQ ID NO: 3388170 - protein, 24 aa, Plasmodium falciparum
LIKSLINNYFNIVRKHIADAVPKA

SEQ ID NO: 3388171 - protein, 24 aa, Plasmodium falciparum
LIKTLYNLCELFLNYMKNINDFAN

SEQ ID NO: 3388172 - protein, 18 aa, Plasmodium falciparum
LILCCYISFNSSLQVKKN

SEQ ID NO: 3388173 - protein, 25 aa, Plasmodium falciparum
LILKNFMYDIYSIYKPLTCYMPKAH

SEQ ID NO: 3388174 - protein, 18 aa, Plasmodium falciparum
LILLDDSIFIIYTYCINK

SEQ ID NO: 3388175 - protein, 19 aa, Plasmodium falciparum
LINCNPLQCLGYDSNQRNK

SEQ ID NO: 3388176 - protein, 31 aa, Plasmodium falciparum
LINDGHIITILSIKYSLNLPSDLSQKFIQFY

SEQ ID NO: 3388177 - protein, 19 aa, Plasmodium falciparum
LINEIIYKKKFQTIKKNKN

SEQ ID NO: 3388178 - protein, 18 aa, Plasmodium falciparum
LINIINLLDKISENKRDK

SEQ ID NO: 3388179 - protein, 26 aa, Plasmodium falciparum
LININNIFDIYIISSLIQLVQRGEKL

SEQ ID NO: 3388180 - protein, 32 aa, Plasmodium falciparum
LINKEKHVLLYLELLVLKNMYRNYLVKLLNSS

SEQ ID NO: 3388181 - protein, 24 aa, Plasmodium falciparum
LINKNSFVLCFSEKYGKLIFSAYK

SEQ ID NO: 3388182 - protein, 21 aa, Plasmodium falciparum
LINNLPFKFSDISLNSFEKKK

SEQ ID NO: 3388183 - protein, 17 aa, Plasmodium falciparum
LINPHSHPYQLPMNNNI

SEQ ID NO: 3388184 - protein, 17 aa, Plasmodium falciparum
LINRILVSAKYIRKELY

SEQ ID NO: 3388185 - protein, 17 aa, Plasmodium falciparum
LINSAKKYIPMVWSFIM

SEQ ID NO: 3388186 - protein, 23 aa, Plasmodium falciparum
LINSLHRLPLYTGVTIKSCENTC

SEQ ID NO: 3388187 - protein, 28 aa, Plasmodium falciparum
LINTDIIILLRPLILDKVPIVQQNATLI

SEQ ID NO: 3388188 - protein, 17 aa, Plasmodium falciparum
LINTISPSDIITTKDKI

SEQ ID NO: 3388189 - protein, 39 aa, Plasmodium falciparum
LINTKNVLVPYYMSEMQFWKSYFFNIDIIYNEIADDIFD

SEQ ID NO: 3388190 - protein, 19 aa, Plasmodium falciparum
LINTLNTFLSDKDNSLHAV

SEQ ID NO: 3388191 - protein, 20 aa, Plasmodium falciparum
LINVHNFFPYFYVEKPDDFD

SEQ ID NO: 3388192 - protein, 22 aa, Plasmodium falciparum
LINYDYVACQALILAPTRELAQ

SEQ ID NO: 3388193 - protein, 18 aa, Plasmodium falciparum
LIPTCWIRSYLYSKYIGN

SEQ ID NO: 3388194 - protein, 18 aa, Plasmodium falciparum
LIQPLNEGVKLIAVVDSC

SEQ ID NO: 3388195 - protein, 20 aa, Plasmodium falciparum
LIQTHKVTQFYTAPTALRAL

SEQ ID NO: 3388196 - protein, 20 aa, Plasmodium falciparum
LIQTKLPITLLAILIAPFMT

SEQ ID NO: 3388197 - protein, 17 aa, Plasmodium falciparum
LIQVGIWCIGEFGDLLI

SEQ ID NO: 3388198 - protein, 18 aa, Plasmodium falciparum
LIRAIYIEMLGHDASFAH

SEQ ID NO: 3388199 - protein, 38 aa, Plasmodium falciparum
LIRELDIREFNLSDSIYFIYLISTRAGGLGINLTAANH

SEQ ID NO: 3388200 - protein, 18 aa, Plasmodium falciparum
LIRIIHFQNFLNLLLEDY

SEQ ID NO: 3388201 - protein, 24 aa, Plasmodium falciparum
LIRKKVCMLLHKMYIIEPSLIKDI

SEQ ID NO: 3388202 - protein, 18 aa, Plasmodium falciparum
LIRNKTFLNKSKLEWNKV

SEQ ID NO: 3388203 - protein, 19 aa, Plasmodium falciparum
LIRNLNYDTSPDKVRKIFE

SEQ ID NO: 3388204 - protein, 31 aa, Plasmodium falciparum
LIRNNKNMVKLKYLNKFLGKRSGPSIKNNMN

SEQ ID NO: 3388205 - protein, 25 aa, Plasmodium falciparum
LIRRNYHYILFTSLKSKMFKKISYE

SEQ ID NO: 3388206 - protein, 24 aa, Plasmodium falciparum
LISELKRGPELPIKGKSKELNLLI

SEQ ID NO: 3388207 - protein, 26 aa, Plasmodium falciparum
LISHPLTSNPLWNRAVILITNKEKNN

SEQ ID NO: 3388208 - protein, 30 aa, Plasmodium falciparum
LISLECLQVNLLIPFYKKKTKRIDNHFFLF

SEQ ID NO: 3388209 - protein, 47 aa, Plasmodium falciparum
LISPSYYYIYVHRYMYLSNIIPKCLEFFKSFILPFYGNKFGVYFECI

SEQ ID NO: 3388210 - protein, 18 aa, Plasmodium falciparum
LISTFSQYLLFFVQNNMV

SEQ ID NO: 3388211 - protein, 18 aa, Plasmodium falciparum
LISTYKKWIYNISQSDKS

SEQ ID NO: 3388212 - protein, 25 aa, Plasmodium falciparum
LISYAIQDVIYLKPLILCILDKFII

SEQ ID NO: 3388213 - protein, 20 aa, Plasmodium falciparum
LITAEKLLEHVLSQYPQIFN

SEQ ID NO: 3388214 - protein, 20 aa, Plasmodium falciparum
LITNGKYSNDLFFHQNGFNN

SEQ ID NO: 3388215 - protein, 17 aa, Plasmodium falciparum
LITNGLYNFKLFNVSNM

SEQ ID NO: 3388216 - protein, 18 aa, Plasmodium falciparum
LITVEEYADILTACNFKN

SEQ ID NO: 3388217 - protein, 17 aa, Plasmodium falciparum
LIVKFAIGELEKYGVNM

SEQ ID NO: 3388218 - protein, 23 aa, Plasmodium falciparum
LIVLLGKLNYYKCFIIGGSVVYQ

SEQ ID NO: 3388219 - protein, 24 aa, Plasmodium falciparum
LIYDILIIRQVLYKGFRVILTLPT

SEQ ID NO: 3388220 - protein, 36 aa, Plasmodium falciparum
LIYDNILHLNIYVKSIWLCMNLKCTFSIHDLILIAR

SEQ ID NO: 3388221 - protein, 20 aa, Plasmodium falciparum
LIYLYKKCRNAYVIKLYVYF

SEQ ID NO: 3388222 - protein, 18 aa, Plasmodium falciparum
LIYPFNYESDVHKNMNMS

SEQ ID NO: 3388223 - protein, 29 aa, Plasmodium falciparum
LIYRNKYVRYLFYYIYRNNKNNLLEGINK

SEQ ID NO: 3388224 - protein, 18 aa, Plasmodium falciparum
LIYYERCTFKGANHIIFF

SEQ ID NO: 3388225 - protein, 17 aa, Plasmodium falciparum
LIYYGKNSNLLNNNTNH

SEQ ID NO: 3388226 - protein, 17 aa, Plasmodium falciparum
LIYYHCDHIYKGHPKYI

SEQ ID NO: 3388227 - protein, 25 aa, Plasmodium falciparum
LKALDMSLPTHLNFVLISLNLPPHE

SEQ ID NO: 3388228 - protein, 24 aa, Plasmodium falciparum
LKATPLKCDIIIPSVLNLNEMVIK

SEQ ID NO: 3388229 - protein, 21 aa, Plasmodium falciparum
LKCCGYRWCLTGTPLQNRISE

SEQ ID NO: 3388230 - protein, 23 aa, Plasmodium falciparum
LKCGWGFPTGCSLNHCAAHYTPN

SEQ ID NO: 3388231 - protein, 18 aa, Plasmodium falciparum
LKCKKYLNDLLKRKEFDL

SEQ ID NO: 3388232 - protein, 27 aa, Plasmodium falciparum
LKCRKKKLEVILWVKIYMSVLEEQKNE

SEQ ID NO: 3388233 - protein, 19 aa, Plasmodium falciparum
LKCTFSIHDLILIARSFKN

SEQ ID NO: 3388234 - protein, 29 aa, Plasmodium falciparum
LKDEIPNKQWLYFLKSYKKRISKNIIVCT

SEQ ID NO: 3388235 - protein, 25 aa, Plasmodium falciparum
LKDEVSYSILLHGKLLISKRKKDNA

SEQ ID NO: 3388236 - protein, 26 aa, Plasmodium falciparum
LKDIKTLNKILLLNNSNLNSVKGVSL

SEQ ID NO: 3388237 - protein, 18 aa, Plasmodium falciparum
LKDINLNRQKSLPPQLYT

SEQ ID NO: 3388238 - protein, 28 aa, Plasmodium falciparum
LKDKIDISSINLFFLNNYTIKSEDCINT

SEQ ID NO: 3388239 - protein, 18 aa, Plasmodium falciparum
LKDKKWCFCFNSYGKIIN

SEQ ID NO: 3388240 - protein, 24 aa, Plasmodium falciparum
LKDLCDYFNIFSIKYKYKKKMNPQ

SEQ ID NO: 3388241 - protein, 19 aa, Plasmodium falciparum
LKDLRLYFRKKNANFIYES

SEQ ID NO: 3388242 - protein, 21 aa, Plasmodium falciparum
LKDVEIFIKNLCVAKCKSIEN

SEQ ID NO: 3388243 - protein, 33 aa, Plasmodium falciparum
LKEAEFYGIKFLPFPLVFCIGGFDGVEYLNSME

SEQ ID NO: 3388244 - protein, 19 aa, Plasmodium falciparum
LKEAKWLSFQLLNGLAYLH

SEQ ID NO: 3388245 - protein, 19 aa, Plasmodium falciparum
LKEDKLYFYGTKDKNEYEF

SEQ ID NO: 3388246 - protein, 24 aa, Plasmodium falciparum
LKEEATICIHNIKKNLLNSEKSSN

SEQ ID NO: 3388247 - protein, 28 aa, Plasmodium falciparum
LKEEFIRLYKIYKETFFLLFDDIVNNRK

SEQ ID NO: 3388248 - protein, 34 aa, Plasmodium falciparum
LKEEKDILCKFFVYIFPFIIKKLDIKNNFLNKCV

SEQ ID NO: 3388249 - protein, 20 aa, Plasmodium falciparum
LKEFVYIIRYLFNEQLKKRK

SEQ ID NO: 3388250 - protein, 25 aa, Plasmodium falciparum
LKEHKEEIFLLKENIKILQKDNTYL

SEQ ID NO: 3388251 - protein, 22 aa, Plasmodium falciparum
LKEHVINFHKGIKRFFCSKCNI

SEQ ID NO: 3388252 - protein, 17 aa, Plasmodium falciparum
LKEIFMNFGTLKDVQYV

SEQ ID NO: 3388253 - protein, 23 aa, Plasmodium falciparum
LKEIKNMNIGSPLFKCKYNSYSH

SEQ ID NO: 3388254 - protein, 23 aa, Plasmodium falciparum
LKEIKVRIPNFLPLHILHISEIP

SEQ ID NO: 3388255 - protein, 24 aa, Plasmodium falciparum
LKEKFIYERINLGRIPLMLKSMFC

SEQ ID NO: 3388256 - protein, 26 aa, Plasmodium falciparum
LKEKILQIETFILRDPFLVEKLCPIH

SEQ ID NO: 3388257 - protein, 21 aa, Plasmodium falciparum
LKELSKLNKPFKYVATCILME

SEQ ID NO: 3388258 - protein, 27 aa, Plasmodium falciparum
LKENKFRWVMFPIKYKTFWSYYKEIES

SEQ ID NO: 3388259 - protein, 19 aa, Plasmodium falciparum
LKENTLFLKFFEKTRYGYI

SEQ ID NO: 3388260 - protein, 23 aa, Plasmodium falciparum
LKERTTFINTYLGLQVDMTKIKT

SEQ ID NO: 3388261 - protein, 20 aa, Plasmodium falciparum
LKEVLYNHMKYYLKGDNKYN

SEQ ID NO: 3388262 - protein, 21 aa, Plasmodium falciparum
LKEYENLWNLIKEKVKNNEYV

SEQ ID NO: 3388263 - protein, 18 aa, Plasmodium falciparum
LKEYNDSTLLKKLNKEEI

SEQ ID NO: 3388264 - protein, 19 aa, Plasmodium falciparum
LKFCQAFMNELYRHIGPCT

SEQ ID NO: 3388265 - protein, 18 aa, Plasmodium falciparum
LKFDINMELLFSCSKDGS

SEQ ID NO: 3388266 - protein, 21 aa, Plasmodium falciparum
LKFNISNYDIISKLMYELFYE

SEQ ID NO: 3388267 - protein, 25 aa, Plasmodium falciparum
LKFNQCSLMDLLTADYSVNCESCGR

SEQ ID NO: 3388268 - protein, 27 aa, Plasmodium falciparum
LKFVHPKFFNYLFQHVHKYLDKQLEII

SEQ ID NO: 3388269 - protein, 23 aa, Plasmodium falciparum
LKGLICEPDLFHIKLTDDDEFLI

SEQ ID NO: 3388270 - protein, 19 aa, Plasmodium falciparum
LKGLSVFKNLKVLDLRSNF

SEQ ID NO: 3388271 - protein, 39 aa, Plasmodium falciparum
LKGYIYIEADSLYMLKKFLLGFKFINLNEISIVPIQELT

SEQ ID NO: 3388272 - protein, 26 aa, Plasmodium falciparum
LKHFPFSLCDCPGLIFPSLVFNKNDL

SEQ ID NO: 3388273 - protein, 22 aa, Plasmodium falciparum
LKHRVNLFLFYVITEYDEYGYH

SEQ ID NO: 3388274 - protein, 17 aa, Plasmodium falciparum
LKIGRYMSHTLFSRVEK

SEQ ID NO: 3388275 - protein, 19 aa, Plasmodium falciparum
LKIIYSLQLIRYSLYEFMK

SEQ ID NO: 3388276 - protein, 19 aa, Plasmodium falciparum
LKIKSYKKSYDTLFNSYIN

SEQ ID NO: 3388277 - protein, 19 aa, Plasmodium falciparum
LKIKYTKMYQAKVNHITRT

SEQ ID NO: 3388278 - protein, 37 aa, Plasmodium falciparum
LKILKFDIIISEWMGYFLFYECMINTILYARDKYLKE

SEQ ID NO: 3388279 - protein, 20 aa, Plasmodium falciparum
LKILLKNNYVREVFKQFTLS

SEQ ID NO: 3388280 - protein, 24 aa, Plasmodium falciparum
LKINIRMMNLIGRGGFAEVWEVFD

SEQ ID NO: 3388281 - protein, 34 aa, Plasmodium falciparum
LKIQKSFHMYDFFNLSLLFPIKVFKKTDKTLIQL

SEQ ID NO: 3388282 - protein, 21 aa, Plasmodium falciparum
LKIYDLSRGMVKTWSPLLIGK

SEQ ID NO: 3388283 - protein, 25 aa, Plasmodium falciparum
LKIYKDMVEFSIWDEIFYGIQRQGR

SEQ ID NO: 3388284 - protein, 32 aa, Plasmodium falciparum
LKKEFFLQNRISEKTLLLNLYVDYSSMEDTSF

SEQ ID NO: 3388285 - protein, 25 aa, Plasmodium falciparum
LKKENTLLIDKLKYFQTNFNQLDIN

SEQ ID NO: 3388286 - protein, 19 aa, Plasmodium falciparum
LKKFIYNQHLVLEFTIHNT

SEQ ID NO: 3388287 - protein, 18 aa, Plasmodium falciparum
LKKIYKYHPKCSLILRIN

SEQ ID NO: 3388288 - protein, 33 aa, Plasmodium falciparum
LKKKCFDDCLLYLKQLYTFIKNYENNNDKLNIK

SEQ ID NO: 3388289 - protein, 17 aa, Plasmodium falciparum
LKKKNHIYCRCLKISII

SEQ ID NO: 3388290 - protein, 36 aa, Plasmodium falciparum
LKKKRNLLSKFDFLSNFHFDMPYNSSVPFNNSMFSL

SEQ ID NO: 3388291 - protein, 26 aa, Plasmodium falciparum
LKKKYNYNWELFLLAIDEGIKGYRDD

SEQ ID NO: 3388292 - protein, 21 aa, Plasmodium falciparum
LKKLRYEYKNLINIIDSFIDE

SEQ ID NO: 3388293 - protein, 24 aa, Plasmodium falciparum
LKKNIFQFYMNEHEKCCVSVDKNN

SEQ ID NO: 3388294 - protein, 36 aa, Plasmodium falciparum
LKKNIKKNFPNYIDSHFLFLKRELLKIDLDIDIRCP

SEQ ID NO: 3388295 - protein, 27 aa, Plasmodium falciparum
LKKNNLIEKVIKKKAFLEAKNTVFPSL

SEQ ID NO: 3388296 - protein, 37 aa, Plasmodium falciparum
LKKNYTIIDIAPVGKLLIDNCRYLIKSIKNLTSKRDT

SEQ ID NO: 3388297 - protein, 24 aa, Plasmodium falciparum
LKKQLHNIFFILGLVIQNILVDNN

SEQ ID NO: 3388298 - protein, 24 aa, Plasmodium falciparum
LKKRKRSFKYNYDFHLKGGEIYNE

SEQ ID NO: 3388299 - protein, 37 aa, Plasmodium falciparum
LKKRKTMPRLHLTKPPNPIIFINKKKFLKAQKTVHIH

SEQ ID NO: 3388300 - protein, 17 aa, Plasmodium falciparum
LKKRKYEINYKGLNNSK

SEQ ID NO: 3388301 - protein, 17 aa, Plasmodium falciparum
LKKRLTVFKSETSPLIS

SEQ ID NO: 3388302 - protein, 26 aa, Plasmodium falciparum
LKKRNNNIILKPSNFYNFPMDTSSSN

SEQ ID NO: 3388303 - protein, 29 aa, Plasmodium falciparum
LKKSDLYVKYALLYLAYTPLNDLNDYDRI

SEQ ID NO: 3388304 - protein, 19 aa, Plasmodium falciparum
LKKSIWFSSIGLELNDFLN

SEQ ID NO: 3388305 - protein, 20 aa, Plasmodium falciparum
LKKYGLLCTGTFKKFKINSD

SEQ ID NO: 3388306 - protein, 18 aa, Plasmodium falciparum
LKKYLKYYDISNGGKRNQ

SEQ ID NO: 3388307 - protein, 22 aa, Plasmodium falciparum
LKKYLLLINLFNLKNKDINFIL

SEQ ID NO: 3388308 - protein, 20 aa, Plasmodium falciparum
LKLKIRNNYFEKNAIRSKIV

SEQ ID NO: 3388309 - protein, 27 aa, Plasmodium falciparum
LKLLSERKFLCFPSLKIFAILLNDIET

SEQ ID NO: 3388310 - protein, 26 aa, Plasmodium falciparum
LKLLSKVLHHKFLLNEISAIGNYEQK

SEQ ID NO: 3388311 - protein, 21 aa, Plasmodium falciparum
LKLRYAFWLKFLVKYIFKWLL

SEQ ID NO: 3388312 - protein, 26 aa, Plasmodium falciparum
LKMKRIIHLKYYVPGLLKKLFNVDGS

SEQ ID NO: 3388313 - protein, 26 aa, Plasmodium falciparum
LKNCNLVKPRVILTNSEKSYEQKCGE

SEQ ID NO: 3388314 - protein, 36 aa, Plasmodium falciparum
LKNECIPLFQRLQQNLFFLVMLANQPEDNLDDAHSN

SEQ ID NO: 3388315 - protein, 30 aa, Plasmodium falciparum
LKNEFPTHTNSRFRIFKTNDENVQYPSGNT

SEQ ID NO: 3388316 - protein, 56 aa, Plasmodium falciparum
LKNIFISRNIIYYRYFKNITYTNICKYKYYISNYVISFYYNYLHNDYFHSQNCFLK

SEQ ID NO: 3388317 - protein, 26 aa, Plasmodium falciparum
LKNILPPYCFFLLTEKNQSFKDCIIS

SEQ ID NO: 3388318 - protein, 26 aa, Plasmodium falciparum
LKNIRTIYDLIFSVSFFKFSNCMTDV

SEQ ID NO: 3388319 - protein, 30 aa, Plasmodium falciparum
LKNKEIILLQLIIEPYILRRSKKHVFIDMP

SEQ ID NO: 3388320 - protein, 22 aa, Plasmodium falciparum
LKNKMLKYNFNPSDVQLKTINY

SEQ ID NO: 3388321 - protein, 28 aa, Plasmodium falciparum
LKNKSNRLSLPKFPYKDLKDRCISKCYK

SEQ ID NO: 3388322 - protein, 28 aa, Plasmodium falciparum
LKNKVRFLFFYLDRFVYSPILQILLRNQ

SEQ ID NO: 3388323 - protein, 20 aa, Plasmodium falciparum
LKNLVRLGVQFNPFADNPNY

SEQ ID NO: 3388324 - protein, 25 aa, Plasmodium falciparum
LKNNEQILSLIRMKLKKLPDIERLL

SEQ ID NO: 3388325 - protein, 28 aa, Plasmodium falciparum
LKNNEYEFFIIPIIFNKHNEILYMGVSI

SEQ ID NO: 3388326 - protein, 26 aa, Plasmodium falciparum
LKNNVDWNKIKLLNTSNIKPVVAGVE

SEQ ID NO: 3388327 - protein, 17 aa, Plasmodium falciparum
LKNNYDFVKYSSNLKDG

SEQ ID NO: 3388328 - protein, 23 aa, Plasmodium falciparum
LKNQHEYFKSLKINTLYIIEDIG

SEQ ID NO: 3388329 - protein, 24 aa, Plasmodium falciparum
LKNQNSFYLFFRNEVDLYKSQKNT

SEQ ID NO: 3388330 - protein, 22 aa, Plasmodium falciparum
LKNRLTLNLLKLEKKKLKRKRQ

SEQ ID NO: 3388331 - protein, 24 aa, Plasmodium falciparum
LKNSKLLFFLLNRINNEIKSDDSN

SEQ ID NO: 3388332 - protein, 23 aa, Plasmodium falciparum
LKNTLRLFPLGCNNKLVFMRGYI

SEQ ID NO: 3388333 - protein, 25 aa, Plasmodium falciparum
LKNTQNLLKWKLKYANNTYKTNDHK

SEQ ID NO: 3388334 - protein, 21 aa, Plasmodium falciparum
LKPVNINIPTPTKLPSRYTNF

SEQ ID NO: 3388335 - protein, 17 aa, Plasmodium falciparum
LKQDFTAQYLNHTGPYV

SEQ ID NO: 3388336 - protein, 19 aa, Plasmodium falciparum
LKQGLIVDFLILKNNKPFL

SEQ ID NO: 3388337 - protein, 26 aa, Plasmodium falciparum
LKQKLEQLIYYLFNKNNIEIKWESDT

SEQ ID NO: 3388338 - protein, 25 aa, Plasmodium falciparum
LKQNDFIYLLRQKTKFRVKYKDENY

SEQ ID NO: 3388339 - protein, 34 aa, Plasmodium falciparum
LKQTEYHLQGIKYWWKNIHSFLGLNSFNNNEDIK

SEQ ID NO: 3388340 - protein, 30 aa, Plasmodium falciparum
LKRDDFSITLSNNYIYLYGGVIQTGKTWQV

SEQ ID NO: 3388341 - protein, 25 aa, Plasmodium falciparum
LKREDIIKDFYYAKVLSLENRDIVL

SEQ ID NO: 3388342 - protein, 19 aa, Plasmodium falciparum
LKRKEFLLKMLNYHKEHNL

SEQ ID NO: 3388343 - protein, 24 aa, Plasmodium falciparum
LKRKKIIRSPFWLSNVMPTEEDVM

SEQ ID NO: 3388344 - protein, 20 aa, Plasmodium falciparum
LKRTSLYNEKKNEKIEPSLL

SEQ ID NO: 3388345 - protein, 25 aa, Plasmodium falciparum
LKSANPIISPFSPGNIRNLENYYNN

SEQ ID NO: 3388346 - protein, 33 aa, Plasmodium falciparum
LKSDNVYEYIYKDIYYDSYYDKNTYIYYDNKYT

SEQ ID NO: 3388347 - protein, 35 aa, Plasmodium falciparum
LKSGITFEQLYPDKGPPIVRVFENVGVYNVSLIRD

SEQ ID NO: 3388348 - protein, 25 aa, Plasmodium falciparum
LKSGIYNFLIVALSLYEINYKPIGI

SEQ ID NO: 3388349 - protein, 23 aa, Plasmodium falciparum
LKSKKEKILTMDILNFSKEHMQL

SEQ ID NO: 3388350 - protein, 42 aa, Plasmodium falciparum
LKSKVEIMKLFYTNQIKTFREAFLYILGWDIKIEQNDEEIFF

SEQ ID NO: 3388351 - protein, 22 aa, Plasmodium falciparum
LKSKWFNVNILPYNLNSINTIY

SEQ ID NO: 3388352 - protein, 30 aa, Plasmodium falciparum
LKSSKKKCLLIFIKDIKFYTYKNIDTKNEY

SEQ ID NO: 3388353 - protein, 29 aa, Plasmodium falciparum
LKSSYKKCIYLLFFREKFLKKYKQNINPL

SEQ ID NO: 3388354 - protein, 20 aa, Plasmodium falciparum
LKSYFHYINSYVDILYTNKN

SEQ ID NO: 3388355 - protein, 26 aa, Plasmodium falciparum
LKTFGKSFLNFAPTYMTKKLKILDNN

SEQ ID NO: 3388356 - protein, 33 aa, Plasmodium falciparum
LKTVILGLSYYHSLLLGRFLYGKIGFSQSYSFN

SEQ ID NO: 3388357 - protein, 19 aa, Plasmodium falciparum
LKVAMRALGFEPKKEDIRK

SEQ ID NO: 3388358 - protein, 21 aa, Plasmodium falciparum
LKVHNFLLKNVPVLKNVMGVN

SEQ ID NO: 3388359 - protein, 23 aa, Plasmodium falciparum
LKVLTHTCHMKKGLKYLVDKYDI

SEQ ID NO: 3388360 - protein, 25 aa, Plasmodium falciparum
LKVNTYFIIGHIYGKIKRIYNSNNE

SEQ ID NO: 3388361 - protein, 23 aa, Plasmodium falciparum
LKWVKTKWDNIQYKGFHKLICFS

SEQ ID NO: 3388362 - protein, 20 aa, Plasmodium falciparum
LKYILDIPSMVLYSYPHINY

SEQ ID NO: 3388363 - protein, 18 aa, Plasmodium falciparum
LKYLIDDVGIFFTKLPIT

SEQ ID NO: 3388364 - protein, 18 aa, Plasmodium falciparum
LLADRLFLKKTRKTNYKL

SEQ ID NO: 3388365 - protein, 18 aa, Plasmodium falciparum
LLADYKYTDDHYGKKDLK

SEQ ID NO: 3388366 - protein, 24 aa, Plasmodium falciparum
LLAIEFILSDVCEYKQIYLHEGIG

SEQ ID NO: 3388367 - protein, 29 aa, Plasmodium falciparum
LLAKCLIKEPYLALPAYQAAIKELWKSED

SEQ ID NO: 3388368 - protein, 24 aa, Plasmodium falciparum
LLARRQKLMKYLYKTDFELYKHTC

SEQ ID NO: 3388369 - protein, 19 aa, Plasmodium falciparum
LLCARRFLKSLNLDTQFLG

SEQ ID NO: 3388370 - protein, 24 aa, Plasmodium falciparum
LLCGYIPDIILPANVRKVKHPKNC

SEQ ID NO: 3388371 - protein, 19 aa, Plasmodium falciparum
LLCLKYNLELIKTSKNFIS

SEQ ID NO: 3388372 - protein, 21 aa, Plasmodium falciparum
LLCNKDYIFSKIIMESLENNE

SEQ ID NO: 3388373 - protein, 32 aa, Plasmodium falciparum
LLCRPSELKLFYLFEQILRQLSLFPSYPSEYN

SEQ ID NO: 3388374 - protein, 24 aa, Plasmodium falciparum
LLCSFKNIILIYSLKKKYIHYPFQ

SEQ ID NO: 3388375 - protein, 19 aa, Plasmodium falciparum
LLCSLPDILDKNLFIEYIL

SEQ ID NO: 3388376 - protein, 18 aa, Plasmodium falciparum
LLCTPGRLSFLLQETKLS

SEQ ID NO: 3388377 - protein, 34 aa, Plasmodium falciparum
LLDEALLRPGRLDQLIYIPLPDLGARISILTAIL

SEQ ID NO: 3388378 - protein, 17 aa, Plasmodium falciparum
LLDLGFESQIYNILRNC

SEQ ID NO: 3388379 - protein, 29 aa, Plasmodium falciparum
LLDLLNSCKVSLSFIKYLIFDEADEMISL

SEQ ID NO: 3388380 - protein, 24 aa, Plasmodium falciparum
LLDNETLYYLNPSGKFVLGGPAAD

SEQ ID NO: 3388381 - protein, 19 aa, Plasmodium falciparum
LLDNLVNCEIIILDILSSV

SEQ ID NO: 3388382 - protein, 24 aa, Plasmodium falciparum
LLDNNYLSILFYSLKDYIWEKKER

SEQ ID NO: 3388383 - protein, 24 aa, Plasmodium falciparum
LLDSLEKLLIKNVSFNFVRKEYIN

SEQ ID NO: 3388384 - protein, 18 aa, Plasmodium falciparum
LLECFNINHLLDTPFMKT

SEQ ID NO: 3388385 - protein, 20 aa, Plasmodium falciparum
LLEELILNPTVCKYVPGELY

SEQ ID NO: 3388386 - protein, 18 aa, Plasmodium falciparum
LLEHVLSQYPQIFNEFKN

SEQ ID NO: 3388387 - protein, 20 aa, Plasmodium falciparum
LLEKEKILFEKSKKIKNLLN

SEQ ID NO: 3388388 - protein, 26 aa, Plasmodium falciparum
LLEKRRLILKSLLTPEAHARLSRIAI

SEQ ID NO: 3388389 - protein, 19 aa, Plasmodium falciparum
LLEKTAIYVIYKILSKLDN

SEQ ID NO: 3388390 - protein, 33 aa, Plasmodium falciparum
LLEKTTTLIIEQFYDTIFSFTYITNITAQQLLL

SEQ ID NO: 3388391 - protein, 18 aa, Plasmodium falciparum
LLENKIYSYITTLTKYTE

SEQ ID NO: 3388392 - protein, 27 aa, Plasmodium falciparum
LLENNEILTLYILRKNLKNDKIEVLHR

SEQ ID NO: 3388393 - protein, 20 aa, Plasmodium falciparum
LLENYVIIFGGLNSEVPFVA

SEQ ID NO: 3388394 - protein, 17 aa, Plasmodium falciparum
LLEYFKKFPSFDFNNLN

SEQ ID NO: 3388395 - protein, 17 aa, Plasmodium falciparum
LLEYRKSNKLHLVRLII

SEQ ID NO: 3388396 - protein, 26 aa, Plasmodium falciparum
LLFEIELLSFREAKKSIYDYTDEEKV

SEQ ID NO: 3388397 - protein, 40 aa, Plasmodium falciparum
LLFESDILLDLFFFYVELKYYKGIFLFLKSLFVGIPNFKE

SEQ ID NO: 3388398 - protein, 18 aa, Plasmodium falciparum
LLFIKYNYDIIFNQKEKR

SEQ ID NO: 3388399 - protein, 25 aa, Plasmodium falciparum
LLFKVLCDSIDIPCRYIRYVKNKTV

SEQ ID NO: 3388400 - protein, 18 aa, Plasmodium falciparum
LLHDSSYEIKKKTRRGTN

SEQ ID NO: 3388401 - protein, 17 aa, Plasmodium falciparum
LLHEEACKKLKGILKEC

SEQ ID NO: 3388402 - protein, 18 aa, Plasmodium falciparum
LLHNTEINFIPDIDPIDV

SEQ ID NO: 3388403 - protein, 18 aa, Plasmodium falciparum
LLIFLKRIFNKNDNIYLY

SEQ ID NO: 3388404 - protein, 26 aa, Plasmodium falciparum
LLKDDLYIFNNFLKELFPFIKIKNEK

SEQ ID NO: 3388405 - protein, 24 aa, Plasmodium falciparum
LLKDESFVGPPIPPIPPVVPSESN

SEQ ID NO: 3388406 - protein, 27 aa, Plasmodium falciparum
LLKHHSYIYGIIFLFNIGKHYKNNKYI

SEQ ID NO: 3388407 - protein, 21 aa, Plasmodium falciparum
LLKIDNCLNIYPQLNDIPLSS

SEQ ID NO: 3388408 - protein, 17 aa, Plasmodium falciparum
LLKIEGRSKKYSDITLY

SEQ ID NO: 3388409 - protein, 30 aa, Plasmodium falciparum
LLKKAEKENFIFLHKLKKRNYTKMLQDLEN

SEQ ID NO: 3388410 - protein, 26 aa, Plasmodium falciparum
LLKKKMEWIQLPPFKITTNQKKTFFH

SEQ ID NO: 3388411 - protein, 18 aa, Plasmodium falciparum
LLKKLIEYKYQILKKQNN

SEQ ID NO: 3388412 - protein, 27 aa, Plasmodium falciparum
LLKNKNFFINPCRIYIRNYPAVLEQNT

SEQ ID NO: 3388413 - protein, 30 aa, Plasmodium falciparum
LLKNKYNWDILSIRSLWAFGPENNSPNILV

SEQ ID NO: 3388414 - protein, 33 aa, Plasmodium falciparum
LLKSMLEYDFTKRPLFNVIAKKLEQIRIQAEDK

SEQ ID NO: 3388415 - protein, 28 aa, Plasmodium falciparum
LLLEVDNLKFILNDLLSYVDHKDGKRNK

SEQ ID NO: 3388416 - protein, 20 aa, Plasmodium falciparum
LLLHNQWPELLSVTFEFCNS

SEQ ID NO: 3388417 - protein, 25 aa, Plasmodium falciparum
LLLNISYIPMKIHIILISCVEGFMG

SEQ ID NO: 3388418 - protein, 32 aa, Plasmodium falciparum
LLLNKRCCELIRSLRIKLIYDESLKSSISPDS

SEQ ID NO: 3388419 - protein, 18 aa, Plasmodium falciparum
LLLVKYEMKNLFTKGEEA

SEQ ID NO: 3388420 - protein, 18 aa, Plasmodium falciparum
LLLYMLNHEQNKEKQLQI

SEQ ID NO: 3388421 - protein, 28 aa, Plasmodium falciparum
LLNERKKIKMIILDIERKLIQNKEIGAH

SEQ ID NO: 3388422 - protein, 29 aa, Plasmodium falciparum
LLNFKKRKNSFLLMKNEILYKSKINEAQA

SEQ ID NO: 3388423 - protein, 17 aa, Plasmodium falciparum
LLNIFQKNKDKIKEIHI

SEQ ID NO: 3388424 - protein, 19 aa, Plasmodium falciparum
LLNIHTILMYPKLFNQMTY

SEQ ID NO: 3388425 - protein, 17 aa, Plasmodium falciparum
LLNILKRKKKQLKYNKE

SEQ ID NO: 3388426 - protein, 22 aa, Plasmodium falciparum
LLNNAMPHFWKTYDPNGFSLYY

SEQ ID NO: 3388427 - protein, 23 aa, Plasmodium falciparum
LLNRYNIMRPQRSADMLIRNYLY

SEQ ID NO: 3388428 - protein, 17 aa, Plasmodium falciparum
LLQEASLINVKKTTKLY

SEQ ID NO: 3388429 - protein, 17 aa, Plasmodium falciparum
LLQEYMKEYNRATTVPH

SEQ ID NO: 3388430 - protein, 19 aa, Plasmodium falciparum
LLQTRPFKLGIEDIQNLGS

SEQ ID NO: 3388431 - protein, 18 aa, Plasmodium falciparum
LLQYLKTKHIPIIIEHKE

SEQ ID NO: 3388432 - protein, 18 aa, Plasmodium falciparum
LLQYLMLNNKMDILKEFK

SEQ ID NO: 3388433 - protein, 18 aa, Plasmodium falciparum
LLRALEFLDAIILNIKFD

SEQ ID NO: 3388434 - protein, 18 aa, Plasmodium falciparum
LLRDIFLKTDNYIEGRYL

SEQ ID NO: 3388435 - protein, 28 aa, Plasmodium falciparum
LLRNGLCSDFFFFFFKSNCYINHNKKGN

SEQ ID NO: 3388436 - protein, 21 aa, Plasmodium falciparum
LLRVLDIHKGDYGIPTLKSSN

SEQ ID NO: 3388437 - protein, 30 aa, Plasmodium falciparum
LLSDDKYFNTVLPRLPIKIKNVYGARLMII

SEQ ID NO: 3388438 - protein, 18 aa, Plasmodium falciparum
LLSENTLSLWLDVEKKYT

SEQ ID NO: 3388439 - protein, 17 aa, Plasmodium falciparum
LLSFEIPFNQIQKITAR

SEQ ID NO: 3388440 - protein, 18 aa, Plasmodium falciparum
LLSIFKKEKNTKPFYETI

SEQ ID NO: 3388441 - protein, 29 aa, Plasmodium falciparum
LLSKKDDNYWTKNYYDPLSYYDDNNNNNN

SEQ ID NO: 3388442 - protein, 20 aa, Plasmodium falciparum
LLSLNYEIGDIILLSIMLDR

SEQ ID NO: 3388443 - protein, 18 aa, Plasmodium falciparum
LLTALYDKLNIWNNRRKK

SEQ ID NO: 3388444 - protein, 29 aa, Plasmodium falciparum
LLTFEELKELFLFFFPEQVMSIDENIIKE

SEQ ID NO: 3388445 - protein, 19 aa, Plasmodium falciparum
LLTNIIYKLSYLNVNYLAL

SEQ ID NO: 3388446 - protein, 20 aa, Plasmodium falciparum
LLTYDMIYSLSRFNKIKTSL

SEQ ID NO: 3388447 - protein, 69 aa, Plasmodium falciparum
LLVDHKTNGLVLAQLKQQFILQFKKELNSLHFGYKKLQNLLMAEPFNKYYKLYIPNNNLHRTHIQHKKY

SEQ ID NO: 3388448 - protein, 19 aa, Plasmodium falciparum
LLVEVMKLQWIGDTYDILS

SEQ ID NO: 3388449 - protein, 33 aa, Plasmodium falciparum
LLVHFRGRLFIGCHINYSYFKIKTFLAMIKNNE

SEQ ID NO: 3388450 - protein, 20 aa, Plasmodium falciparum
LLVHRFWKDQFVKELDILLK

SEQ ID NO: 3388451 - protein, 20 aa, Plasmodium falciparum
LLYEGINLIFDKWTILRLAV

SEQ ID NO: 3388452 - protein, 40 aa, Plasmodium falciparum
LLYEYNKMNAFNLRLMECYSTWIFYDMNFQKNQFFSLKSK

SEQ ID NO: 3388453 - protein, 19 aa, Plasmodium falciparum
LLYGFFEFYSNDICKNGIT

SEQ ID NO: 3388454 - protein, 18 aa, Plasmodium falciparum
LLYIVKLNKNVIINKCEK

SEQ ID NO: 3388455 - protein, 18 aa, Plasmodium falciparum
LLYKRMKEIYLWKKIICS

SEQ ID NO: 3388456 - protein, 17 aa, Plasmodium falciparum
LLYLNIQCKEKVYKYLK

SEQ ID NO: 3388457 - protein, 28 aa, Plasmodium falciparum
LMACDIYGDILKYIYLDNIYIDIIKKEK

SEQ ID NO: 3388458 - protein, 22 aa, Plasmodium falciparum
LMADIRFLNLLFDFSKNEKDNI

SEQ ID NO: 3388459 - protein, 37 aa, Plasmodium falciparum
LMCDRICNILLFENLLPFILNFKTVHAIKLLLHKNNQ

SEQ ID NO: 3388460 - protein, 17 aa, Plasmodium falciparum
LMCEIINYPKFLYVLHS

SEQ ID NO: 3388461 - protein, 20 aa, Plasmodium falciparum
LMEFITFFVVNHRCAYISNF

SEQ ID NO: 3388462 - protein, 19 aa, Plasmodium falciparum
LMHYAGHMGSIFKLDSKAY

SEQ ID NO: 3388463 - protein, 25 aa, Plasmodium falciparum
LMILDNAINFFLYEKILDLRNVPYD

SEQ ID NO: 3388464 - protein, 25 aa, Plasmodium falciparum
LMKLNLISHYEKMKNFISTNTYPTI

SEQ ID NO: 3388465 - protein, 25 aa, Plasmodium falciparum
LMKNHNPQALPYKNAPKKKKNTGIF

SEQ ID NO: 3388466 - protein, 17 aa, Plasmodium falciparum
LMLANLKYLELQDLLLK

SEQ ID NO: 3388467 - protein, 29 aa, Plasmodium falciparum
LMNAKNICLWIYPILSLCKISWYHRNYIE

SEQ ID NO: 3388468 - protein, 25 aa, Plasmodium falciparum
LMNHNIIPMDIIPNNGNYYNNMNNY

SEQ ID NO: 3388469 - protein, 18 aa, Plasmodium falciparum
LMNIATFQSLIDPLSGRI

SEQ ID NO: 3388470 - protein, 18 aa, Plasmodium falciparum
LMNLLYKKHYNTYKNRVF

SEQ ID NO: 3388471 - protein, 23 aa, Plasmodium falciparum
LMNNKFMNISFHLDILTKKLEEK

SEQ ID NO: 3388472 - protein, 20 aa, Plasmodium falciparum
LMNNQILLRSYNESLDFNNN

SEQ ID NO: 3388473 - protein, 20 aa, Plasmodium falciparum
LMNVKNYLKSFYYDRNKKKK

SEQ ID NO: 3388474 - protein, 25 aa, Plasmodium falciparum
LMQKNIMLMDNIPQDSLLQKIKNNN

SEQ ID NO: 3388475 - protein, 20 aa, Plasmodium falciparum
LMRSLGKLILYNNPDLILFV

SEQ ID NO: 3388476 - protein, 27 aa, Plasmodium falciparum
LMTNPRSPYYMLNYINEKKLDIFKKIT

SEQ ID NO: 3388477 - protein, 18 aa, Plasmodium falciparum
LMYDLKITSEWKAYQKNK

SEQ ID NO: 3388478 - protein, 25 aa, Plasmodium falciparum
LMYNEKLIKLNYEKTLLYNHIDIPD

SEQ ID NO: 3388479 - protein, 25 aa, Plasmodium falciparum
LMYSNNNFFGQGLQKDLDFLENEQN

SEQ ID NO: 3388480 - protein, 20 aa, Plasmodium falciparum
LMYYHDFKNIILKRNSFLYI

SEQ ID NO: 3388481 - protein, 40 aa, Plasmodium falciparum
LNAELYFEKLKDKILIYKNIKYRILTFYDPVVIDYDEQAT

SEQ ID NO: 3388482 - protein, 26 aa, Plasmodium falciparum
LNAKDNFICTTSILPNFYETPPDKAS

SEQ ID NO: 3388483 - protein, 19 aa, Plasmodium falciparum
LNCDSIFLNYNFYEDLDTL

SEQ ID NO: 3388484 - protein, 18 aa, Plasmodium falciparum
LNCNIVNNNLLDLSNERI

SEQ ID NO: 3388485 - protein, 25 aa, Plasmodium falciparum
LNDAFNKINLAITSWNIFNEENKEG

SEQ ID NO: 3388486 - protein, 26 aa, Plasmodium falciparum
LNDDKIKYIIPFFSNHNKINIFKKNI

SEQ ID NO: 3388487 - protein, 24 aa, Plasmodium falciparum
LNDENVKRNLLNGLLVCNEEDNEE

SEQ ID NO: 3388488 - protein, 26 aa, Plasmodium falciparum
LNDHKSWVLVVLFSPDNKFLATAGMD

SEQ ID NO: 3388489 - protein, 27 aa, Plasmodium falciparum
LNDIIELKLYKEIKFITILYNNAEKEL

SEQ ID NO: 3388490 - protein, 26 aa, Plasmodium falciparum
LNDIKISFYDIFEKMLNGEYKKEFEE

SEQ ID NO: 3388491 - protein, 26 aa, Plasmodium falciparum
LNDILMNCIPQVFHLYKNINTSNDIK

SEQ ID NO: 3388492 - protein, 26 aa, Plasmodium falciparum
LNDIYLVMEYIEHELKMILDNKSPSF

SEQ ID NO: 3388493 - protein, 20 aa, Plasmodium falciparum
LNDLSAFNFFEYITKLQSES

SEQ ID NO: 3388494 - protein, 42 aa, Plasmodium falciparum
LNDNIYIFDKIKKCIYLYTPYNNVWYIFLNIYEEMSLRKNTL

SEQ ID NO: 3388495 - protein, 24 aa, Plasmodium falciparum
LNDQINKLIFIKNKWEARIVELGG

SEQ ID NO: 3388496 - protein, 32 aa, Plasmodium falciparum
LNDRTYRFYLRTPTVVWFIRRCARVPMFSSMA

SEQ ID NO: 3388497 - protein, 17 aa, Plasmodium falciparum
LNDSMYWRGIVGGCLKN

SEQ ID NO: 3388498 - protein, 30 aa, Plasmodium falciparum
LNDTFSKKDWYLLNNFAIKMMQYRKGDKKS

SEQ ID NO: 3388499 - protein, 25 aa, Plasmodium falciparum
LNDYYGFYVILEFFYNIEQMDKDKF

SEQ ID NO: 3388500 - protein, 25 aa, Plasmodium falciparum
LNEDNLYIYYYNYALLRDQMKCKMF

SEQ ID NO: 3388501 - protein, 29 aa, Plasmodium falciparum
LNEDYNIYEAIYHILSFEKKHRFQELLKF

SEQ ID NO: 3388502 - protein, 44 aa, Plasmodium falciparum
LNEEEVALYVFQIADALSYLHNFNIIHRDLKPDNILIHYSNEHL

SEQ ID NO: 3388503 - protein, 30 aa, Plasmodium falciparum
LNEEICIELVIFFIILQFLKNDNTKKMYDK

SEQ ID NO: 3388504 - protein, 30 aa, Plasmodium falciparum
LNEENIYNYIFFFKKICKLFSTCYVNNDML

SEQ ID NO: 3388505 - protein, 29 aa, Plasmodium falciparum
LNEENMRRYLLLALLLMNNNISYKRCNEI

SEQ ID NO: 3388506 - protein, 26 aa, Plasmodium falciparum
LNEIQKYQLTLLRKSNPSCPKPAKCE

SEQ ID NO: 3388507 - protein, 23 aa, Plasmodium falciparum
LNEIYNMFLKKVCKNKYLGLILL

SEQ ID NO: 3388508 - protein, 23 aa, Plasmodium falciparum
LNEKAIWPLYERYGHALDALKEA

SEQ ID NO: 3388509 - protein, 27 aa, Plasmodium falciparum
LNEKKKLYFSYNLIGYIKKKGFANLAV

SEQ ID NO: 3388510 - protein, 29 aa, Plasmodium falciparum
LNEKKQDYLLNLIQKYFIKKRKPNRIIHQ

SEQ ID NO: 3388511 - protein, 22 aa, Plasmodium falciparum
LNEKNIIPYFLTNVFDMEQKKK

SEQ ID NO: 3388512 - protein, 29 aa, Plasmodium falciparum
LNELAPKYRNLVILPIYSSLPVEYQARIF

SEQ ID NO: 3388513 - protein, 34 aa, Plasmodium falciparum
LNELKTIIKFCSDLNLLCLFSTKNFKENLIIYFG

SEQ ID NO: 3388514 - protein, 41 aa, Plasmodium falciparum
LNELRQNLFLCAINFHLNYWAEKVILFYPHNEKINKYCTKL

SEQ ID NO: 3388515 - protein, 24 aa, Plasmodium falciparum
LNENIQMIPQNNIYFASTSSNNNM

SEQ ID NO: 3388516 - protein, 35 aa, Plasmodium falciparum
LNENKTIYYSLIHALFFFGILNVEITPLDNEEIKE

SEQ ID NO: 3388517 - protein, 20 aa, Plasmodium falciparum
LNEQWEVYWFENNKLNAKPF

SEQ ID NO: 3388518 - protein, 22 aa, Plasmodium falciparum
LNERIVDIVLFPHNLKFGVLGI

SEQ ID NO: 3388519 - protein, 20 aa, Plasmodium falciparum
LNESFLFNHLNKKEFEIIVN

SEQ ID NO: 3388520 - protein, 39 aa, Plasmodium falciparum
LNESGFIFRQELVSMLPVLFLRLKENFFVLDICAAPGSK

SEQ ID NO: 3388521 - protein, 27 aa, Plasmodium falciparum
LNETLCLLKLAMINRIYIFLKQTHDYI

SEQ ID NO: 3388522 - protein, 19 aa, Plasmodium falciparum
LNEYEILSVFWIYNETIRK

SEQ ID NO: 3388523 - protein, 33 aa, Plasmodium falciparum
LNEYRNIILLYLESKMFYLAPNVTMLLGSSLTA

SEQ ID NO: 3388524 - protein, 26 aa, Plasmodium falciparum
LNFIQFYFTIFETIRYFLKKQKVFCY

SEQ ID NO: 3388525 - protein, 34 aa, Plasmodium falciparum
LNFRENIYDIFNNLLYYFLSKIDLNKLRENISKR

SEQ ID NO: 3388526 - protein, 17 aa, Plasmodium falciparum
LNFSYMTGLRSSKVKYI

SEQ ID NO: 3388527 - protein, 17 aa, Plasmodium falciparum
LNFYPLLTPYHNIEKIV

SEQ ID NO: 3388528 - protein, 24 aa, Plasmodium falciparum
LNGNQLCFVKLLINNLVAGSVIGK

SEQ ID NO: 3388529 - protein, 25 aa, Plasmodium falciparum
LNHAILDIYNKLSLLDNNKLENVKK

SEQ ID NO: 3388530 - protein, 28 aa, Plasmodium falciparum
LNHDWFKGNIFPIHNFNLYINKDNNNKN

SEQ ID NO: 3388531 - protein, 19 aa, Plasmodium falciparum
LNHGNFLCYIICPNVLNKE

SEQ ID NO: 3388532 - protein, 24 aa, Plasmodium falciparum
LNHQLPCYNILNNIKRINKIKSIA

SEQ ID NO: 3388533 - protein, 26 aa, Plasmodium falciparum
LNHTKLGTFLLPTVQLCNSSSLIIPM

SEQ ID NO: 3388534 - protein, 19 aa, Plasmodium falciparum
LNICKFSRIFLFENEHFIS

SEQ ID NO: 3388535 - protein, 28 aa, Plasmodium falciparum
LNIHKRTPLIYQLMKNDIYTYEKKLIKS

SEQ ID NO: 3388536 - protein, 17 aa, Plasmodium falciparum
LNIIKRHNFKHIYIIGR

SEQ ID NO: 3388537 - protein, 19 aa, Plasmodium falciparum
LNIKFLLTNIIYKLSYLNV

SEQ ID NO: 3388538 - protein, 24 aa, Plasmodium falciparum
LNIKYMSLLFYSNIIHLFVHMYQP

SEQ ID NO: 3388539 - protein, 18 aa, Plasmodium falciparum
LNILYNKINEFDKYKNDD

SEQ ID NO: 3388540 - protein, 27 aa, Plasmodium falciparum
LNINNIHDILPNYIPYQQSIQHEYNFL

SEQ ID NO: 3388541 - protein, 30 aa, Plasmodium falciparum
LNINNSYVRKFVLSVFRFLTNSIDNADPLS

SEQ ID NO: 3388542 - protein, 17 aa, Plasmodium falciparum
LNIPDIYFRNILKEFCI

SEQ ID NO: 3388543 - protein, 22 aa, Plasmodium falciparum
LNIQFMSHYLGYEGRCAIPSNF

SEQ ID NO: 3388544 - protein, 18 aa, Plasmodium falciparum
LNIRRLLQRRPFDVGSAP

SEQ ID NO: 3388545 - protein, 31 aa, Plasmodium falciparum
LNITSFYKIIQNILPKRILLDNTKKGLEEAN

SEQ ID NO: 3388546 - protein, 26 aa, Plasmodium falciparum
LNIYLNMQILYHYFSIYKNKAVINYI

SEQ ID NO: 3388547 - protein, 21 aa, Plasmodium falciparum
LNKCLISERPTFLQKLAVAKT

SEQ ID NO: 3388548 - protein, 46 aa, Plasmodium falciparum
LNKENKELIYVFKKQLDLIVILKKQINLLQNNKILNITSNEFKKIM

SEQ ID NO: 3388549 - protein, 35 aa, Plasmodium falciparum
LNKINVKNIFKYKGYIIHLIQQSNVFCKIFKHFNE

SEQ ID NO: 3388550 - protein, 38 aa, Plasmodium falciparum
LNKIVLQIFIPSIKKNYLKYLNILYYKNTNILDIHTSE

SEQ ID NO: 3388551 - protein, 22 aa, Plasmodium falciparum
LNKKKLCHFLINVLDKINEEEN

SEQ ID NO: 3388552 - protein, 29 aa, Plasmodium falciparum
LNKKMLLIESKWILHKLKEKYPTYFTYKN

SEQ ID NO: 3388553 - protein, 24 aa, Plasmodium falciparum
LNKLERKPYMIKKDVTKGMVYRKK

SEQ ID NO: 3388554 - protein, 26 aa, Plasmodium falciparum
LNKNGNLISLLKPGGIPLACSHIMES

SEQ ID NO: 3388555 - protein, 27 aa, Plasmodium falciparum
LNKNINMSLYMKCITHFSIKDLSKTLI

SEQ ID NO: 3388556 - protein, 23 aa, Plasmodium falciparum
LNKNLVEMILRNNKPSIDKNIHE

SEQ ID NO: 3388557 - protein, 25 aa, Plasmodium falciparum
LNKNYLKMNEFLLKTLNASTNDNNT

SEQ ID NO: 3388558 - protein, 17 aa, Plasmodium falciparum
LNKSFGKMHYENIHAVR

SEQ ID NO: 3388559 - protein, 25 aa, Plasmodium falciparum
LNKSILASYKLYYSMRPKVSKYVST

SEQ ID NO: 3388560 - protein, 18 aa, Plasmodium falciparum
LNKSSFLSNKIYFSNIHK

SEQ ID NO: 3388561 - protein, 33 aa, Plasmodium falciparum
LNKYKGSSFALIIHEISDLLSLITTVDKSKNKN

SEQ ID NO: 3388562 - protein, 35 aa, Plasmodium falciparum
LNKYQSVLLDTLWYYQMLGLLYLYQDDFKTSNLYF

SEQ ID NO: 3388563 - protein, 20 aa, Plasmodium falciparum
LNKYTFPNDVFLLNNTKISD

SEQ ID NO: 3388564 - protein, 19 aa, Plasmodium falciparum
LNLIRKSILFYNKDINVKS

SEQ ID NO: 3388565 - protein, 17 aa, Plasmodium falciparum
LNLLYRSSNNNNNNNNN

SEQ ID NO: 3388566 - protein, 18 aa, Plasmodium falciparum
LNLMRIVVVYLKKYINIY

SEQ ID NO: 3388567 - protein, 33 aa, Plasmodium falciparum
LNLNRKKIFKNKKLINFITFACPHIGVHENMAI

SEQ ID NO: 3388568 - protein, 30 aa, Plasmodium falciparum
LNLQVANRIFIVDPWWNPAAELQAIQRAHR

SEQ ID NO: 3388569 - protein, 20 aa, Plasmodium falciparum
LNMLAVVYLACREAGHIKSI

SEQ ID NO: 3388570 - protein, 18 aa, Plasmodium falciparum
LNMLGIRDSIYKIDEKNN

SEQ ID NO: 3388571 - protein, 30 aa, Plasmodium falciparum
LNMVNYKMKHPLFYCSNEQLKRFVYRMYLN

SEQ ID NO: 3388572 - protein, 23 aa, Plasmodium falciparum
LNNDKLNFHAYNKHFNNPFNNFD

SEQ ID NO: 3388573 - protein, 36 aa, Plasmodium falciparum
LNNEDEEYILFLKYIYNDLLSFIESNKDYYLNNSNY

SEQ ID NO: 3388574 - protein, 20 aa, Plasmodium falciparum
LNNEYVYGTNLNFKHARNVN

SEQ ID NO: 3388575 - protein, 18 aa, Plasmodium falciparum
LNNGDFYDYFLEKSWSLM

SEQ ID NO: 3388576 - protein, 27 aa, Plasmodium falciparum
LNNIEPIIISIIYKQNFWYNNILNKSE

SEQ ID NO: 3388577 - protein, 22 aa, Plasmodium falciparum
LNNIFFSFFTSFKLMKNEEFKE

SEQ ID NO: 3388578 - protein, 33 aa, Plasmodium falciparum
LNNIIGYYHYINLNRLTYYLEKVNANFVYNHHI

SEQ ID NO: 3388579 - protein, 20 aa, Plasmodium falciparum
LNNIIKKYKEYFYKIKNEEE

SEQ ID NO: 3388580 - protein, 34 aa, Plasmodium falciparum
LNNIKNNLYVMFQLPIILYNVLFEKTINSFNDYI

SEQ ID NO: 3388581 - protein, 42 aa, Plasmodium falciparum
LNNIMNIRLIYRTVEIYLFSMRQFIYLLKEKNNFISHILDEQ

SEQ ID NO: 3388582 - protein, 29 aa, Plasmodium falciparum
LNNINTYLIQYPLRPKYRPYNFTNNIQKI

SEQ ID NO: 3388583 - protein, 25 aa, Plasmodium falciparum
LNNINYVKYFLPLCIQPKTNNTDKC

SEQ ID NO: 3388584 - protein, 26 aa, Plasmodium falciparum
LNNISILKKWMKAKFYISTYRPQEIK

SEQ ID NO: 3388585 - protein, 21 aa, Plasmodium falciparum
LNNIYELRGWWVKVGQFLSTQ

SEQ ID NO: 3388586 - protein, 19 aa, Plasmodium falciparum
LNNKENMNFFVNKKNIHNS

SEQ ID NO: 3388587 - protein, 17 aa, Plasmodium falciparum
LNNLIMVIVPNLSNYCV

SEQ ID NO: 3388588 - protein, 23 aa, Plasmodium falciparum
LNNLKFDLIIYNIKSNIVYRKNS

SEQ ID NO: 3388589 - protein, 17 aa, Plasmodium falciparum
LNNMHIFTSRFLFIGKN

SEQ ID NO: 3388590 - protein, 26 aa, Plasmodium falciparum
LNNNEKTFFFFSNVNNNKMVECNNMN

SEQ ID NO: 3388591 - protein, 22 aa, Plasmodium falciparum
LNNNIMNNNIINKSFINASNND

SEQ ID NO: 3388592 - protein, 24 aa, Plasmodium falciparum
LNNPKNLLLYTFELDRLIEKNNFE

SEQ ID NO: 3388593 - protein, 25 aa, Plasmodium falciparum
LNNPNVMNAPHPFNKMNYNYHNMNP

SEQ ID NO: 3388594 - protein, 27 aa, Plasmodium falciparum
LNNSIHNIYFLPYEITTCFYSENYNMK

SEQ ID NO: 3388595 - protein, 18 aa, Plasmodium falciparum
LNNTLLWNDLNFPEYENV

SEQ ID NO: 3388596 - protein, 17 aa, Plasmodium falciparum
LNNVLALKLLTLSSKTK

SEQ ID NO: 3388597 - protein, 23 aa, Plasmodium falciparum
LNNYIYLLDINLNSEIRNLEIVN

SEQ ID NO: 3388598 - protein, 19 aa, Plasmodium falciparum
LNPAYKLLRSLAVLRMRKS

SEQ ID NO: 3388599 - protein, 19 aa, Plasmodium falciparum
LNPKNFLNDLTLNNNYTNY

SEQ ID NO: 3388600 - protein, 34 aa, Plasmodium falciparum
LNQAKKIMLPLLNDFIQNNFYKYIKFYEDNQNSS

SEQ ID NO: 3388601 - protein, 19 aa, Plasmodium falciparum
LNQGLINCNPLQCLGYDSN

SEQ ID NO: 3388602 - protein, 31 aa, Plasmodium falciparum
LNQHTNCFFVYFFKVIHTFDFLANNLSDLRG

SEQ ID NO: 3388603 - protein, 17 aa, Plasmodium falciparum
LNQIKKTFLKKIPFHRT

SEQ ID NO: 3388604 - protein, 23 aa, Plasmodium falciparum
LNQINLDMSILSSDSLKNAYSFY

SEQ ID NO: 3388605 - protein, 25 aa, Plasmodium falciparum
LNQLAITYICKWLKYNISKLEPEKE

SEQ ID NO: 3388606 - protein, 18 aa, Plasmodium falciparum
LNQLIVMETFLYDKKREH

SEQ ID NO: 3388607 - protein, 19 aa, Plasmodium falciparum
LNQLNKEYYFYGGFDLEEI

SEQ ID NO: 3388608 - protein, 20 aa, Plasmodium falciparum
LNQQKLLLNSIYQKTEKVKK

SEQ ID NO: 3388609 - protein, 28 aa, Plasmodium falciparum
LNRDRFLPFIQLLFKFNYIFEIDNYHDF

SEQ ID NO: 3388610 - protein, 22 aa, Plasmodium falciparum
LNRKYELFIKYLKEKGKIECNK

SEQ ID NO: 3388611 - protein, 28 aa, Plasmodium falciparum
LNRLNTGIYGSLYKFLTPKKKMKNKDSE

SEQ ID NO: 3388612 - protein, 29 aa, Plasmodium falciparum
LNRNECFLYGRKIYIVYVPIKNDVKHDNN

SEQ ID NO: 3388613 - protein, 19 aa, Plasmodium falciparum
LNRQKSLPPQLYTTQDITQ

SEQ ID NO: 3388614 - protein, 27 aa, Plasmodium falciparum
LNSHYNNLPYPMPIYESMNNPQMYMQH

SEQ ID NO: 3388615 - protein, 19 aa, Plasmodium falciparum
LNSINYIDQNYLSYNNLNC

SEQ ID NO: 3388616 - protein, 21 aa, Plasmodium falciparum
LNSLILLYINCEYYEYAINML

SEQ ID NO: 3388617 - protein, 23 aa, Plasmodium falciparum
LNSMDIIILINMITSMKSFKNAE

SEQ ID NO: 3388618 - protein, 27 aa, Plasmodium falciparum
LNSNLLIAFFQSLLPWYQVDYNGTNSR

SEQ ID NO: 3388619 - protein, 22 aa, Plasmodium falciparum
LNSPYMEPFKKQNIDVLLLLEE

SEQ ID NO: 3388620 - protein, 35 aa, Plasmodium falciparum
LNSRKEFEMQQKYFANLFSLHILAVGWNVNKGDGM

SEQ ID NO: 3388621 - protein, 17 aa, Plasmodium falciparum
LNSVFNEETCTIWDLVM

SEQ ID NO: 3388622 - protein, 21 aa, Plasmodium falciparum
LNTCTIPEWWNLELYFGDSEN

SEQ ID NO: 3388623 - protein, 33 aa, Plasmodium falciparum
LNTFYESFIYGCGFFLSNRLLDQIFGPRTYDTY

SEQ ID NO: 3388624 - protein, 22 aa, Plasmodium falciparum
LNTLCKSILLNFGASAVCIPTL

SEQ ID NO: 3388625 - protein, 19 aa, Plasmodium falciparum
LNTQKLFLLENDKICANSH

SEQ ID NO: 3388626 - protein, 27 aa, Plasmodium falciparum
LNTQYRMNNLILLWSNKIFYEQKLVSH

SEQ ID NO: 3388627 - protein, 29 aa, Plasmodium falciparum
LNTSIRNFIKILILLKKLLKKKIHFDDEE

SEQ ID NO: 3388628 - protein, 26 aa, Plasmodium falciparum
LNTTTCENIFFFDNLNIEENYINKCV

SEQ ID NO: 3388629 - protein, 24 aa, Plasmodium falciparum
LNVIQYFYIHLYNKNMQKISFPSN

SEQ ID NO: 3388630 - protein, 18 aa, Plasmodium falciparum
LNVLRIINEPTAAAIAYG

SEQ ID NO: 3388631 - protein, 29 aa, Plasmodium falciparum
LNVQNVHTFFHKYFYLKKNTDDTYDNIHF

SEQ ID NO: 3388632 - protein, 18 aa, Plasmodium falciparum
LNYADYFCNLLDVGGIPE

SEQ ID NO: 3388633 - protein, 18 aa, Plasmodium falciparum
LNYDKFVLNYLIENKNND

SEQ ID NO: 3388634 - protein, 25 aa, Plasmodium falciparum
LNYEEELFFPFLGNNYILNYNFIIG

SEQ ID NO: 3388635 - protein, 22 aa, Plasmodium falciparum
LNYEYFSLILFGGYGGYDRSSY

SEQ ID NO: 3388636 - protein, 26 aa, Plasmodium falciparum
LNYKYELYHQLLAYNSFKKSGIPVKI

SEQ ID NO: 3388637 - protein, 23 aa, Plasmodium falciparum
LNYLPMICKPKRWENFEGGMLLL

SEQ ID NO: 3388638 - protein, 25 aa, Plasmodium falciparum
LNYNLHKYPFLYERTIKDLKDTSYS

SEQ ID NO: 3388639 - protein, 22 aa, Plasmodium falciparum
LNYREINLLMKILAETKRVVSM

SEQ ID NO: 3388640 - protein, 33 aa, Plasmodium falciparum
LNYSDFHNFLKTKKLLFAIHKWENNQYLFHYNT

SEQ ID NO: 3388641 - protein, 19 aa, Plasmodium falciparum
LPDQYPFHLCNEFKNDMQS

SEQ ID NO: 3388642 - protein, 25 aa, Plasmodium falciparum
LPEGLLVWGLYLSEIFYFFCESVEE

SEQ ID NO: 3388643 - protein, 27 aa, Plasmodium falciparum
LPEIGTNGYFLNKKLINTADKNITTNN

SEQ ID NO: 3388644 - protein, 32 aa, Plasmodium falciparum
LPEKEISPLCSFLLPMLSVDPQTRPSAYTMLQ

SEQ ID NO: 3388645 - protein, 17 aa, Plasmodium falciparum
LPELLTLYIVKLNERDI

SEQ ID NO: 3388646 - protein, 37 aa, Plasmodium falciparum
LPFEKEEMWWIVIGIKKMNLLLSIKKLSLLKSVNNIK

SEQ ID NO: 3388647 - protein, 25 aa, Plasmodium falciparum
LPFNGINCLFWNPIYLNSHKFFLKK

SEQ ID NO: 3388648 - protein, 17 aa, Plasmodium falciparum
LPFSYQIFRVKNIKVLK

SEQ ID NO: 3388649 - protein, 17 aa, Plasmodium falciparum
LPHIMDVAEIDLVWFEW

SEQ ID NO: 3388650 - protein, 18 aa, Plasmodium falciparum
LPHVIIKKYFGVISLHIV

SEQ ID NO: 3388651 - protein, 17 aa, Plasmodium falciparum
LPILCKYLDFRDTHIIC

SEQ ID NO: 3388652 - protein, 28 aa, Plasmodium falciparum
LPILKEIVEILFSKGLIKVLFATETFAM

SEQ ID NO: 3388653 - protein, 22 aa, Plasmodium falciparum
LPIPGRALFLKKDDKIHILMKK

SEQ ID NO: 3388654 - protein, 30 aa, Plasmodium falciparum
LPISHVLERTFAYSIILFGGTLNIWSKDLN

SEQ ID NO: 3388655 - protein, 21 aa, Plasmodium falciparum
LPIYSYRYDILKAIKNNKILI

SEQ ID NO: 3388656 - protein, 20 aa, Plasmodium falciparum
LPKCALACIKALIKKNKSTT

SEQ ID NO: 3388657 - protein, 18 aa, Plasmodium falciparum
LPKLPSKKSLKPYPECAF

SEQ ID NO: 3388658 - protein, 21 aa, Plasmodium falciparum
LPLLVCLPNFHISPKAFLINL

SEQ ID NO: 3388659 - protein, 25 aa, Plasmodium falciparum
LPNDIKLSLYKYYKQSTLGNCNIKE

SEQ ID NO: 3388660 - protein, 21 aa, Plasmodium falciparum
LPNKIYPFHNKIDIVYKENDG

SEQ ID NO: 3388661 - protein, 27 aa, Plasmodium falciparum
LPSALKIYEKLLYVSFRIIQKPGYVFV

SEQ ID NO: 3388662 - protein, 19 aa, Plasmodium falciparum
LPSNLVHTPFINSNDYVCS

SEQ ID NO: 3388663 - protein, 20 aa, Plasmodium falciparum
LPTILLRKNGKYLDKIIGMN

SEQ ID NO: 3388664 - protein, 22 aa, Plasmodium falciparum
LPTPTEVYEYKKSIKLKEELDG

SEQ ID NO: 3388665 - protein, 17 aa, Plasmodium falciparum
LPVLEHVLQNQSSLLVI

SEQ ID NO: 3388666 - protein, 20 aa, Plasmodium falciparum
LQALGHQWFLPKLTDMHMTA

SEQ ID NO: 3388667 - protein, 24 aa, Plasmodium falciparum
LQDEDFFYFVKCDMNFDNFELTKN

SEQ ID NO: 3388668 - protein, 22 aa, Plasmodium falciparum
LQDINMIYKTLYDMAIKYGNCL

SEQ ID NO: 3388669 - protein, 26 aa, Plasmodium falciparum
LQEFGAMQVYFYEPGSNNDGWAWVGF

SEQ ID NO: 3388670 - protein, 26 aa, Plasmodium falciparum
LQGGKQLCIIFDTTYTSYFVPVPTSI

SEQ ID NO: 3388671 - protein, 21 aa, Plasmodium falciparum
LQGLYKILYTMENLQKLIIGF

SEQ ID NO: 3388672 - protein, 33 aa, Plasmodium falciparum
LQHIYNYNFFFLFYNFHLFLLSTQPIKDFNFFV

SEQ ID NO: 3388673 - protein, 18 aa, Plasmodium falciparum
LQHKILSALFNNISKETL

SEQ ID NO: 3388674 - protein, 26 aa, Plasmodium falciparum
LQIVTISLRLLFRPHTQHLPYLHSTL

SEQ ID NO: 3388675 - protein, 25 aa, Plasmodium falciparum
LQKACAMLIELKRYSKSYISIVVEE

SEQ ID NO: 3388676 - protein, 25 aa, Plasmodium falciparum
LQKDFSIYFVNIFDIAICSNYLNFK

SEQ ID NO: 3388677 - protein, 34 aa, Plasmodium falciparum
LQKGHITCAYWLSNSYIYACIDLLRQMIYIKNKN

SEQ ID NO: 3388678 - protein, 24 aa, Plasmodium falciparum
LQKLGAQIRWCSCNIYSTADYAAA

SEQ ID NO: 3388679 - protein, 19 aa, Plasmodium falciparum
LQKLKWYCQMCEKQCRDEN

SEQ ID NO: 3388680 - protein, 28 aa, Plasmodium falciparum
LQKNPYKFNEIFLLPIDIKNNVKDEKNN

SEQ ID NO: 3388681 - protein, 23 aa, Plasmodium falciparum
LQKSFPLIEWWQGKEILHKIQKK

SEQ ID NO: 3388682 - protein, 19 aa, Plasmodium falciparum
LQKYEKIWNRAKGYHTYNY

SEQ ID NO: 3388683 - protein, 18 aa, Plasmodium falciparum
LQKYIIYARTNCKPSLSD

SEQ ID NO: 3388684 - protein, 17 aa, Plasmodium falciparum
LQKYLCEQLIKNNLKNK

SEQ ID NO: 3388685 - protein, 18 aa, Plasmodium falciparum
LQLFLHFYEKNSDEWQEM

SEQ ID NO: 3388686 - protein, 19 aa, Plasmodium falciparum
LQLHVCSCIYCQNGILCNF

SEQ ID NO: 3388687 - protein, 18 aa, Plasmodium falciparum
LQMNLSNISLDYKKKDIN

SEQ ID NO: 3388688 - protein, 25 aa, Plasmodium falciparum
LQNARNRMYIDYDKIIREIYERYRR

SEQ ID NO: 3388689 - protein, 21 aa, Plasmodium falciparum
LQNCLNTTLLYIKCILKDTNI

SEQ ID NO: 3388690 - protein, 33 aa, Plasmodium falciparum
LQNDDYFKRASNIKNLLIYLKENSKIENHEDYI

SEQ ID NO: 3388691 - protein, 19 aa, Plasmodium falciparum
LQNELYFQTFINNSYILLQ

SEQ ID NO: 3388692 - protein, 17 aa, Plasmodium falciparum
LQNGYMNNFMGPKGINI

SEQ ID NO: 3388693 - protein, 25 aa, Plasmodium falciparum
LQNKNKLFDLLRNIDKKNLRDVIFK

SEQ ID NO: 3388694 - protein, 28 aa, Plasmodium falciparum
LQNNINKFITLSFYFSNIVILHISKENC

SEQ ID NO: 3388695 - protein, 29 aa, Plasmodium falciparum
LQNNLSELWSLLNFLLPKIFSSCVDFEKW

SEQ ID NO: 3388696 - protein, 17 aa, Plasmodium falciparum
LQNVLITRPIEPDMVDV

SEQ ID NO: 3388697 - protein, 19 aa, Plasmodium falciparum
LQPCILLLDNIETICYKED

SEQ ID NO: 3388698 - protein, 22 aa, Plasmodium falciparum
LQQFFNNFIFKCEEKLYMEEGI

SEQ ID NO: 3388699 - protein, 18 aa, Plasmodium falciparum
LQQQVHGPFPNVNMSRSS

SEQ ID NO: 3388700 - protein, 23 aa, Plasmodium falciparum
LQQSCLDCLFCFLNDFKNNVHEK

SEQ ID NO: 3388701 - protein, 24 aa, Plasmodium falciparum
LQRIHQFCHLELSDILWCYCVNKF

SEQ ID NO: 3388702 - protein, 29 aa, Plasmodium falciparum
LQRLAEDFQYIYLLKYASNEKESTSRLAF

SEQ ID NO: 3388703 - protein, 24 aa, Plasmodium falciparum
LQRQKIIWRKWIAKNLYHIESNVM

SEQ ID NO: 3388704 - protein, 21 aa, Plasmodium falciparum
LQSFFSLKYLINKHKNIKYIN

SEQ ID NO: 3388705 - protein, 17 aa, Plasmodium falciparum
LQSLKCLLANKNFLTML

SEQ ID NO: 3388706 - protein, 22 aa, Plasmodium falciparum
LQSLKDSCFLEYYNINKSNNLN

SEQ ID NO: 3388707 - protein, 17 aa, Plasmodium falciparum
LQSYILSNPINAACVNE

SEQ ID NO: 3388708 - protein, 18 aa, Plasmodium falciparum
LQVFFLQEMERIKKVIDL

SEQ ID NO: 3388709 - protein, 17 aa, Plasmodium falciparum
LQYIKKKKKVKKNKCHD

SEQ ID NO: 3388710 - protein, 35 aa, Plasmodium falciparum
LQYLDFIGNNKFLKLKFILHLLSIMENICIHICSL

SEQ ID NO: 3388711 - protein, 17 aa, Plasmodium falciparum
LRALMKYGDEWIQKYDL

SEQ ID NO: 3388712 - protein, 25 aa, Plasmodium falciparum
LRALTEMNGYIFKGCKIKVSKSNGI

SEQ ID NO: 3388713 - protein, 25 aa, Plasmodium falciparum
LRARDLFYAVWVPDLFMKRVKENKN

SEQ ID NO: 3388714 - protein, 33 aa, Plasmodium falciparum
LRDAFIQSAAVGTFFLWHNYKEQFKAQHGAVEA

SEQ ID NO: 3388715 - protein, 26 aa, Plasmodium falciparum
LRDANHLIYKCPVPLDKALTGFQFIV

SEQ ID NO: 3388716 - protein, 17 aa, Plasmodium falciparum
LRDILLNQLKEKNGTYD

SEQ ID NO: 3388717 - protein, 18 aa, Plasmodium falciparum
LRDLMTRPNIFTGRKILG

SEQ ID NO: 3388718 - protein, 19 aa, Plasmodium falciparum
LRECKHVIKLIGVCSLREG

SEQ ID NO: 3388719 - protein, 42 aa, Plasmodium falciparum
LREDQVIYLLSIFFKKIVHLILPQLLNLKIWLEQQCSYSFCS

SEQ ID NO: 3388720 - protein, 21 aa, Plasmodium falciparum
LREFYLSFADALLTKEEEKND

SEQ ID NO: 3388721 - protein, 21 aa, Plasmodium falciparum
LREISIYIFQIYNLGMYDNNL

SEQ ID NO: 3388722 - protein, 24 aa, Plasmodium falciparum
LRERIPKRIIFFNNLVNVNSEPGS

SEQ ID NO: 3388723 - protein, 22 aa, Plasmodium falciparum
LRERSFYICKNIKFPELTNNEG

SEQ ID NO: 3388724 - protein, 23 aa, Plasmodium falciparum
LRGPRSALIFFNKKRNPGIDQKI

SEQ ID NO: 3388725 - protein, 25 aa, Plasmodium falciparum
LRIENLKNIKILYNNQIYALEYMSF

SEQ ID NO: 3388726 - protein, 18 aa, Plasmodium falciparum
LRIFLHEDGLVRFSIEKY

SEQ ID NO: 3388727 - protein, 19 aa, Plasmodium falciparum
LRILFEHIKNEYDKAILCI

SEQ ID NO: 3388728 - protein, 36 aa, Plasmodium falciparum
LRISERLRAFVFDKDLTAYYIKKLKDIFKLETEAAK

SEQ ID NO: 3388729 - protein, 18 aa, Plasmodium falciparum
LRKISRCIIELLNSPRSS

SEQ ID NO: 3388730 - protein, 19 aa, Plasmodium falciparum
LRKNLLYRKPRNKKEYLDF

SEQ ID NO: 3388731 - protein, 18 aa, Plasmodium falciparum
LRKREYLLSGKPLEEIGA

SEQ ID NO: 3388732 - protein, 18 aa, Plasmodium falciparum
LRKWADIFILCPLDANTL

SEQ ID NO: 3388733 - protein, 21 aa, Plasmodium falciparum
LRLKILQLLYNSFNVNFSFRF

SEQ ID NO: 3388734 - protein, 24 aa, Plasmodium falciparum
LRNCSYLFMLELLTACVKVLYRRP

SEQ ID NO: 3388735 - protein, 17 aa, Plasmodium falciparum
LRNIISTYLNSQKILIH

SEQ ID NO: 3388736 - protein, 35 aa, Plasmodium falciparum
LRNNLLLEEKNLLLKQSHLNLLLNNQLKLNNVMSL

SEQ ID NO: 3388737 - protein, 19 aa, Plasmodium falciparum
LRNYISFKKTKICEMWLKN

SEQ ID NO: 3388738 - protein, 17 aa, Plasmodium falciparum
LRNYMYLKYIKGKKNKN

SEQ ID NO: 3388739 - protein, 19 aa, Plasmodium falciparum
LRPGFIIQELKLTEPVFSK

SEQ ID NO: 3388740 - protein, 18 aa, Plasmodium falciparum
LRRIPFQAYAYFCQATLR

SEQ ID NO: 3388741 - protein, 18 aa, Plasmodium falciparum
LRRQMHRSFRKPLIVITP

SEQ ID NO: 3388742 - protein, 17 aa, Plasmodium falciparum
LRRSFRHLPIDIRLNKL

SEQ ID NO: 3388743 - protein, 19 aa, Plasmodium falciparum
LRSCVFLLQNIMKNINIKL

SEQ ID NO: 3388744 - protein, 31 aa, Plasmodium falciparum
LRSTDEFYKTTLCKFFLNGYCKADKNCRHAH

SEQ ID NO: 3388745 - protein, 17 aa, Plasmodium falciparum
LRTNISMDIPFDEQNNN

SEQ ID NO: 3388746 - protein, 30 aa, Plasmodium falciparum
LRVRRNSNLYKYVSFFLSKERMNKERMDDG

SEQ ID NO: 3388747 - protein, 26 aa, Plasmodium falciparum
LRYKDERILFLQDEQKTYLKKYFNIS

SEQ ID NO: 3388748 - protein, 25 aa, Plasmodium falciparum
LRYKKPFFYNYLPKNVKRKLKEMYI

SEQ ID NO: 3388749 - protein, 19 aa, Plasmodium falciparum
LRYRNVNFLKLLEKYIFMN

SEQ ID NO: 3388750 - protein, 17 aa, Plasmodium falciparum
LSALLSHLIKMAEKYIG

SEQ ID NO: 3388751 - protein, 21 aa, Plasmodium falciparum
LSAYEKFYLEKMKVVKHKLNE

SEQ ID NO: 3388752 - protein, 17 aa, Plasmodium falciparum
LSCIITPNFYECKVILE

SEQ ID NO: 3388753 - protein, 21 aa, Plasmodium falciparum
LSCLLAMFLNIRRIISTDIIR

SEQ ID NO: 3388754 - protein, 18 aa, Plasmodium falciparum
LSCNLFLHKDHELMLLLI

SEQ ID NO: 3388755 - protein, 24 aa, Plasmodium falciparum
LSDISNIMVIPYRNYQRDKKDFSE

SEQ ID NO: 3388756 - protein, 18 aa, Plasmodium falciparum
LSDKINMFFCKYNEPAYV

SEQ ID NO: 3388757 - protein, 26 aa, Plasmodium falciparum
LSDLYTFLFFIYENSNFMCLNTYVSN

SEQ ID NO: 3388758 - protein, 18 aa, Plasmodium falciparum
LSDYDKQELLKHLSLNNT

SEQ ID NO: 3388759 - protein, 26 aa, Plasmodium falciparum
LSEDEFVLDPTRITLFTGYSGIDGDT

SEQ ID NO: 3388760 - protein, 35 aa, Plasmodium falciparum
LSEFFFDYNSQYYYHPLYQLYFDNNTKYYMSLSKG

SEQ ID NO: 3388761 - protein, 24 aa, Plasmodium falciparum
LSEIDFFNLIYYSTLDKNVILGSK

SEQ ID NO: 3388762 - protein, 17 aa, Plasmodium falciparum
LSEINFWIGYENALYQL

SEQ ID NO: 3388763 - protein, 22 aa, Plasmodium falciparum
LSELMYLFEYVISKHIVESYLI

SEQ ID NO: 3388764 - protein, 25 aa, Plasmodium falciparum
LSELVNILYYVLNNKELILENFPHK

SEQ ID NO: 3388765 - protein, 25 aa, Plasmodium falciparum
LSEMKRKLILLYNKGICCNYIKEIS

SEQ ID NO: 3388766 - protein, 25 aa, Plasmodium falciparum
LSFNIKEILTMLNFIKLYSNGKGHT

SEQ ID NO: 3388767 - protein, 21 aa, Plasmodium falciparum
LSFYNIISTSPILNKKFVYVK

SEQ ID NO: 3388768 - protein, 30 aa, Plasmodium falciparum
LSGGQRSLLALSLILALLKVRTVPMYILDE

SEQ ID NO: 3388769 - protein, 23 aa, Plasmodium falciparum
LSGRTRIPIKLDIRKRDLKNVGD

SEQ ID NO: 3388770 - protein, 34 aa, Plasmodium falciparum
LSHEKHIFIYSLKCSLLIINLLAKLGGTTYIIKE

SEQ ID NO: 3388771 - protein, 22 aa, Plasmodium falciparum
LSIEQIMKIPGVKLGRNYIQDM

SEQ ID NO: 3388772 - protein, 19 aa, Plasmodium falciparum
LSILCTYAINNPNFNSLCE

SEQ ID NO: 3388773 - protein, 17 aa, Plasmodium falciparum
LSILKRTEWEKEYKHHT

SEQ ID NO: 3388774 - protein, 27 aa, Plasmodium falciparum
LSINHKRLFKIIASIQLENLDKGIYGV

SEQ ID NO: 3388775 - protein, 25 aa, Plasmodium falciparum
LSINNFKLIGFIKGLKGLLNNDICL

SEQ ID NO: 3388776 - protein, 18 aa, Plasmodium falciparum
LSIRDINLYNIKHGKKKN

SEQ ID NO: 3388777 - protein, 33 aa, Plasmodium falciparum
LSIVETLNIKYFFQYKYTFASFLSYYQYLDIAV

SEQ ID NO: 3388778 - protein, 24 aa, Plasmodium falciparum
LSKESFYFMYGIVKHAKALQAFCN

SEQ ID NO: 3388779 - protein, 23 aa, Plasmodium falciparum
LSKGYIEYLKYETAGKMNLSELE

SEQ ID NO: 3388780 - protein, 28 aa, Plasmodium falciparum
LSKIKNKIFMITDFGPVLFLGEQDGDMG

SEQ ID NO: 3388781 - protein, 23 aa, Plasmodium falciparum
LSKILKFSNYFLNGSFWNHINYS

SEQ ID NO: 3388782 - protein, 22 aa, Plasmodium falciparum
LSKLFQLQKYSKVCFPPIITLQ

SEQ ID NO: 3388783 - protein, 19 aa, Plasmodium falciparum
LSKLGKLWSIIEPDMIGEI

SEQ ID NO: 3388784 - protein, 28 aa, Plasmodium falciparum
LSKLIHDDVLLFLSLLNDVFPKFHNITK

SEQ ID NO: 3388785 - protein, 24 aa, Plasmodium falciparum
LSKLNKLFKKIYIYGNLIQTDIFD

SEQ ID NO: 3388786 - protein, 17 aa, Plasmodium falciparum
LSKLRIKYLRIIENYKT

SEQ ID NO: 3388787 - protein, 17 aa, Plasmodium falciparum
LSKLYELNLTINKNIIN

SEQ ID NO: 3388788 - protein, 18 aa, Plasmodium falciparum
LSKMRHHIKRWSKKLNKN

SEQ ID NO: 3388789 - protein, 20 aa, Plasmodium falciparum
LSKMYIHGKLLKVQLKNGEE

SEQ ID NO: 3388790 - protein, 44 aa, Plasmodium falciparum
LSKRGVMYFFILQKLKNLHSFYFYSLEIFLKIFIKCLNDSSPNR

SEQ ID NO: 3388791 - protein, 27 aa, Plasmodium falciparum
LSKTDEFLKFIKLIKRISINALAQTNQ

SEQ ID NO: 3388792 - protein, 17 aa, Plasmodium falciparum
LSKTKNLKFKQMSNIPI

SEQ ID NO: 3388793 - protein, 19 aa, Plasmodium falciparum
LSKTNLQLFKGIRNRKKKI

SEQ ID NO: 3388794 - protein, 34 aa, Plasmodium falciparum
LSKVYIQHNFVPLYFNNGLFKYVYNFSQVEDNTN

SEQ ID NO: 3388795 - protein, 26 aa, Plasmodium falciparum
LSLEKCVDIIYKANLPLTQNKLNKLK

SEQ ID NO: 3388796 - protein, 18 aa, Plasmodium falciparum
LSLHSFPISYSPKNIVLK

SEQ ID NO: 3388797 - protein, 44 aa, Plasmodium falciparum
LSLNGKYLCALINNYYMLIWCVHRNNHFLKLTLVGLNNLSVELQ

SEQ ID NO: 3388798 - protein, 22 aa, Plasmodium falciparum
LSLVKRSCIIKWAKQLKIGGYS

SEQ ID NO: 3388799 - protein, 29 aa, Plasmodium falciparum
LSMNEYSNIFLLKYDSIKYVKKNINYSES

SEQ ID NO: 3388800 - protein, 25 aa, Plasmodium falciparum
LSNDHLEMLLKIFGTIEKIYMDDNE

SEQ ID NO: 3388801 - protein, 27 aa, Plasmodium falciparum
LSNFLYRDVIFLYKVNKIILINNYEFN

SEQ ID NO: 3388802 - protein, 17 aa, Plasmodium falciparum
LSNIKLGHFLTNKNKSQ

SEQ ID NO: 3388803 - protein, 22 aa, Plasmodium falciparum
LSNIYKLKYMKECYYSLFNMYK

SEQ ID NO: 3388804 - protein, 24 aa, Plasmodium falciparum
LSNKFIRLRYIKNPIYAFNDKNHF

SEQ ID NO: 3388805 - protein, 22 aa, Plasmodium falciparum
LSNLAYELKNITFQEYYMAIHN

SEQ ID NO: 3388806 - protein, 25 aa, Plasmodium falciparum
LSNLLNVLWTNAKYFKDFPLLLKYS

SEQ ID NO: 3388807 - protein, 28 aa, Plasmodium falciparum
LSNLYNDVHLYGKYLNNATILDILKRRV

SEQ ID NO: 3388808 - protein, 23 aa, Plasmodium falciparum
LSNMFTCVKLPKDDTLTSVISSI

SEQ ID NO: 3388809 - protein, 21 aa, Plasmodium falciparum
LSNVVLLLKSLHVQNLFEFDF

SEQ ID NO: 3388810 - protein, 17 aa, Plasmodium falciparum
LSPFLVIEFLRNDLKES

SEQ ID NO: 3388811 - protein, 25 aa, Plasmodium falciparum
LSPLYIYNLCTYALAYRLRNALKGN

SEQ ID NO: 3388812 - protein, 21 aa, Plasmodium falciparum
LSRFVSWINGLSVFQIRAGRN

SEQ ID NO: 3388813 - protein, 25 aa, Plasmodium falciparum
LSRHDILLLISFFIQLQNEQKKNEK

SEQ ID NO: 3388814 - protein, 18 aa, Plasmodium falciparum
LSRITYFIHLYTFDENNK

SEQ ID NO: 3388815 - protein, 18 aa, Plasmodium falciparum
LSRLFWKGRKWKGTYWPS

SEQ ID NO: 3388816 - protein, 25 aa, Plasmodium falciparum
LSSFPFFHRSSLKEHIYFHARLVCG

SEQ ID NO: 3388817 - protein, 27 aa, Plasmodium falciparum
LSSLRRTYILFSYFPEALTGLKKIIGE

SEQ ID NO: 3388818 - protein, 22 aa, Plasmodium falciparum
LSSSFCWYLYGCLYKIYKNYDE

SEQ ID NO: 3388819 - protein, 25 aa, Plasmodium falciparum
LSSSFIYFLYCIKNNYSFQTYLLSP

SEQ ID NO: 3388820 - protein, 20 aa, Plasmodium falciparum
LSTINRVEYLTYIQSTSSEK

SEQ ID NO: 3388821 - protein, 18 aa, Plasmodium falciparum
LSTKFNEEQLRELDLKEY

SEQ ID NO: 3388822 - protein, 18 aa, Plasmodium falciparum
LSTLNKNINHKLSETADF

SEQ ID NO: 3388823 - protein, 23 aa, Plasmodium falciparum
LSTSTDHLLKLHKISFPTSNFQN

SEQ ID NO: 3388824 - protein, 21 aa, Plasmodium falciparum
LSTTFPFIWKTGIAQLSFAKT

SEQ ID NO: 3388825 - protein, 24 aa, Plasmodium falciparum
LSTTLNVFMLPQISIILTCYVTDM

SEQ ID NO: 3388826 - protein, 30 aa, Plasmodium falciparum
LSVHSSWLPVLFNMPIVNEIPEWLKTCKYY

SEQ ID NO: 3388827 - protein, 24 aa, Plasmodium falciparum
LSVSFPVVINYIIDTVRCERPITF

SEQ ID NO: 3388828 - protein, 26 aa, Plasmodium falciparum
LSWDFRNLLYCLTLKYKLYDFQIDVL

SEQ ID NO: 3388829 - protein, 20 aa, Plasmodium falciparum
LSYGLLIWASGLAQTTLIQK

SEQ ID NO: 3388830 - protein, 22 aa, Plasmodium falciparum
LSYICKPRYSGISLYISNELPL

SEQ ID NO: 3388831 - protein, 20 aa, Plasmodium falciparum
LSYIFTIFHSAIMYLCDVKN

SEQ ID NO: 3388832 - protein, 17 aa, Plasmodium falciparum
LSYIKGCKQKGIWPITN

SEQ ID NO: 3388833 - protein, 28 aa, Plasmodium falciparum
LSYSMNFSKRPNILARRLCYSHHILSLV

SEQ ID NO: 3388834 - protein, 21 aa, Plasmodium falciparum
LSYYIVLHIFRVLIKSKINKG

SEQ ID NO: 3388835 - protein, 18 aa, Plasmodium falciparum
LTCAPLTVMLRKSNWPVF

SEQ ID NO: 3388836 - protein, 25 aa, Plasmodium falciparum
LTCLNDLFCFISVDLNPVANQTYFH

SEQ ID NO: 3388837 - protein, 24 aa, Plasmodium falciparum
LTCVYNYKHILKNILYLENVIEKY

SEQ ID NO: 3388838 - protein, 23 aa, Plasmodium falciparum
LTDEQIMEYIKLAFLKTDEQFLK

SEQ ID NO: 3388839 - protein, 24 aa, Plasmodium falciparum
LTDNLFYKHYFFNNFPNLQVLDHE

SEQ ID NO: 3388840 - protein, 28 aa, Plasmodium falciparum
LTDRTVRYVLLEYFPFLEKHLNNNHMNE

SEQ ID NO: 3388841 - protein, 24 aa, Plasmodium falciparum
LTEEEAFLFNSNYRGQIKAKTGAE

SEQ ID NO: 3388842 - protein, 19 aa, Plasmodium falciparum
LTETFFVFLKNSERILILT

SEQ ID NO: 3388843 - protein, 19 aa, Plasmodium falciparum
LTEYSFLMNEIPRNFYCLP

SEQ ID NO: 3388844 - protein, 19 aa, Plasmodium falciparum
LTFEKKLENKLNLKKKYII

SEQ ID NO: 3388845 - protein, 25 aa, Plasmodium falciparum
LTFKMNFAFYIPYGSVGIDVLKNVF

SEQ ID NO: 3388846 - protein, 29 aa, Plasmodium falciparum
LTGKQLLKKAMQLWLPAGDTLLEMIVTHL

SEQ ID NO: 3388847 - protein, 18 aa, Plasmodium falciparum
LTHFETIFDLIKKTNWGD

SEQ ID NO: 3388848 - protein, 19 aa, Plasmodium falciparum
LTIDIYNNSLWVYRYFILN

SEQ ID NO: 3388849 - protein, 26 aa, Plasmodium falciparum
LTKDDKIRFLYNNKNYIMELLIHKYH

SEQ ID NO: 3388850 - protein, 25 aa, Plasmodium falciparum
LTKENFFINCLLFRGAVKISEDIKI

SEQ ID NO: 3388851 - protein, 23 aa, Plasmodium falciparum
LTKKDFQYLPYNKNKKKQENIHT

SEQ ID NO: 3388852 - protein, 28 aa, Plasmodium falciparum
LTKKINYKIIIPFSKLAFYEGEIKYTNN

SEQ ID NO: 3388853 - protein, 19 aa, Plasmodium falciparum
LTKLVEGIKPYIKELRNIS

SEQ ID NO: 3388854 - protein, 24 aa, Plasmodium falciparum
LTKYSYFYQTYIKPILDSYKKCKW

SEQ ID NO: 3388855 - protein, 17 aa, Plasmodium falciparum
LTLGFDKQNLHYGDKSY

SEQ ID NO: 3388856 - protein, 17 aa, Plasmodium falciparum
LTLINGNRIKFSPNVFI

SEQ ID NO: 3388857 - protein, 24 aa, Plasmodium falciparum
LTLQKILIIFKNEGIKYLHFSEDT

SEQ ID NO: 3388858 - protein, 20 aa, Plasmodium falciparum
LTLTEIIYPKILELAKNDGD

SEQ ID NO: 3388859 - protein, 21 aa, Plasmodium falciparum
LTLYFKSIIEFFFGKKNINKD

SEQ ID NO: 3388860 - protein, 27 aa, Plasmodium falciparum
LTMLNDFNRLHYYRAAMRWTGHNDVSC

SEQ ID NO: 3388861 - protein, 42 aa, Plasmodium falciparum
LTNFGKDNYIFLFIDKGERTILLNFLTFSIKNINTFIGAEKC

SEQ ID NO: 3388862 - protein, 26 aa, Plasmodium falciparum
LTNIINILNYVFPDYEFKYLNNSNYK

SEQ ID NO: 3388863 - protein, 30 aa, Plasmodium falciparum
LTNINYTFDYILSNLIIKYFKEKKVKSVVD

SEQ ID NO: 3388864 - protein, 24 aa, Plasmodium falciparum
LTNLKNFKYIKKYKYFLSQKNHLK

SEQ ID NO: 3388865 - protein, 23 aa, Plasmodium falciparum
LTNQRLIINYERGYCSDNVINYN

SEQ ID NO: 3388866 - protein, 25 aa, Plasmodium falciparum
LTNSFKYFCNFIKTVNINEPSSIDV

SEQ ID NO: 3388867 - protein, 23 aa, Plasmodium falciparum
LTNYNISRFLQRYGTTTPNTQHN

SEQ ID NO: 3388868 - protein, 21 aa, Plasmodium falciparum
LTPILVAMVIRNSKAHSLLDD

SEQ ID NO: 3388869 - protein, 25 aa, Plasmodium falciparum
LTPNELINLYVPKKSWIQFNNSQNK

SEQ ID NO: 3388870 - protein, 22 aa, Plasmodium falciparum
LTPPSEILCMPGDLILLMSDGV

SEQ ID NO: 3388871 - protein, 26 aa, Plasmodium falciparum
LTPTFKVKRFYVFKDYAFFISQVKEI

SEQ ID NO: 3388872 - protein, 17 aa, Plasmodium falciparum
LTQYLQKELTCPICLDY

SEQ ID NO: 3388873 - protein, 18 aa, Plasmodium falciparum
LTQYLYECKYHMYGNIIC

SEQ ID NO: 3388874 - protein, 25 aa, Plasmodium falciparum
LTRDNKPGDILFFLFSGHGSQEKDH

SEQ ID NO: 3388875 - protein, 19 aa, Plasmodium falciparum
LTRNNIMNFCDYNKMNKPF

SEQ ID NO: 3388876 - protein, 26 aa, Plasmodium falciparum
LTSDPKKTLFIGRLSYEVSEQKLKKE

SEQ ID NO: 3388877 - protein, 17 aa, Plasmodium falciparum
LTSENFYIVRIERISYE

SEQ ID NO: 3388878 - protein, 30 aa, Plasmodium falciparum
LTSSNDGYIKLWDLRFLKDSFFTTNIHSHW

SEQ ID NO: 3388879 - protein, 18 aa, Plasmodium falciparum
LTTFEKYLHIINKNKREK

SEQ ID NO: 3388880 - protein, 28 aa, Plasmodium falciparum
LTVAKSMLSFLYKQLKYCIEDEIQCYYS

SEQ ID NO: 3388881 - protein, 21 aa, Plasmodium falciparum
LTVMLRKSNWPVFTNFICSFS

SEQ ID NO: 3388882 - protein, 20 aa, Plasmodium falciparum
LTVYKIIQYAHALKSVLNAP

SEQ ID NO: 3388883 - protein, 19 aa, Plasmodium falciparum
LTWQILQLLCTSQRGDIVK

SEQ ID NO: 3388884 - protein, 27 aa, Plasmodium falciparum
LTYQIHDIYIWRLIEKKFYDLQHELTP

SEQ ID NO: 3388885 - protein, 24 aa, Plasmodium falciparum
LTYTQNLYDYYLYNENRTIKNDIM

SEQ ID NO: 3388886 - protein, 17 aa, Plasmodium falciparum
LTYYKIYQKKTIKNIKQ

SEQ ID NO: 3388887 - protein, 29 aa, Plasmodium falciparum
LVCLPKSNLIFPVYNLNLYMLKYEDNSLN

SEQ ID NO: 3388888 - protein, 18 aa, Plasmodium falciparum
LVCSIIIRYVKTRISYDE

SEQ ID NO: 3388889 - protein, 22 aa, Plasmodium falciparum
LVCSNYFKNIGFLKDYRRLNVA

SEQ ID NO: 3388890 - protein, 50 aa, Plasmodium falciparum
LVDENYINDFLIYIEKYIYSLNFYLPTQNFNYKKYLLHNGSIHNITLDTH

SEQ ID NO: 3388891 - protein, 28 aa, Plasmodium falciparum
LVDNNNIVYIIYNRKIQLLFNKIIEKIC

SEQ ID NO: 3388892 - protein, 20 aa, Plasmodium falciparum
LVDTHLYDENNKILYNTCLK

SEQ ID NO: 3388893 - protein, 22 aa, Plasmodium falciparum
LVEIIYAVFINENYNFHSYKNS

SEQ ID NO: 3388894 - protein, 23 aa, Plasmodium falciparum
LVERGPYEWPGAKYIIRDNGTKY

SEQ ID NO: 3388895 - protein, 20 aa, Plasmodium falciparum
LVEWPPFILSVEDIEIASLE

SEQ ID NO: 3388896 - protein, 27 aa, Plasmodium falciparum
LVEYNNSCIPPPLKKMIPIDGVRNKSI

SEQ ID NO: 3388897 - protein, 34 aa, Plasmodium falciparum
LVGIRTSLILPYTLFNEELILFIIEQAKNVPEIP

SEQ ID NO: 3388898 - protein, 19 aa, Plasmodium falciparum
LVGTIYYISPEILMRTNYD

SEQ ID NO: 3388899 - protein, 18 aa, Plasmodium falciparum
LVGTYSYFTNNGGLLHAM

SEQ ID NO: 3388900 - protein, 17 aa, Plasmodium falciparum
LVHIFNDEIWKLGPQNV

SEQ ID NO: 3388901 - protein, 21 aa, Plasmodium falciparum
LVHSAQQLCNKLLNQNNIDGE

SEQ ID NO: 3388902 - protein, 27 aa, Plasmodium falciparum
LVIARLMSNYIFLCDPYIPVQTRESLQ

SEQ ID NO: 3388903 - protein, 18 aa, Plasmodium falciparum
LVIIFCFNKLINKAPYEC

SEQ ID NO: 3388904 - protein, 19 aa, Plasmodium falciparum
LVIQIYKLCKKICKNYFHL

SEQ ID NO: 3388905 - protein, 24 aa, Plasmodium falciparum
LVKDVGVMIPLIQKINAETNAIKI

SEQ ID NO: 3388906 - protein, 33 aa, Plasmodium falciparum
LVKKIPKIIDVPVPVKVPKIKVIDKPFYVNKYV

SEQ ID NO: 3388907 - protein, 17 aa, Plasmodium falciparum
LVKYFQTEKKRFGELHQ

SEQ ID NO: 3388908 - protein, 18 aa, Plasmodium falciparum
LVLPLYPQSAECTVSSTL

SEQ ID NO: 3388909 - protein, 31 aa, Plasmodium falciparum
LVLRQLGYSYRRTFEEFLYQYKFVDIAAAED

SEQ ID NO: 3388910 - protein, 29 aa, Plasmodium falciparum
LVLYERRIKSFIFSKLKFNYDNVSYFCFT

SEQ ID NO: 3388911 - protein, 27 aa, Plasmodium falciparum
LVNILDKFIEMYVLCPHCLLPETDIVV

SEQ ID NO: 3388912 - protein, 29 aa, Plasmodium falciparum
LVNKYNHNFFLYNKYIHHIFNNENISFFS

SEQ ID NO: 3388913 - protein, 18 aa, Plasmodium falciparum
LVNLMKSPLLKNKYINHI

SEQ ID NO: 3388914 - protein, 18 aa, Plasmodium falciparum
LVNNSFLGDVLLSAKYEA

SEQ ID NO: 3388915 - protein, 24 aa, Plasmodium falciparum
LVPISLLLTKALTCPLIGTVTLSY

SEQ ID NO: 3388916 - protein, 22 aa, Plasmodium falciparum
LVPQTWKKLYASKKKILYFFED

SEQ ID NO: 3388917 - protein, 19 aa, Plasmodium falciparum
LVQWIEFKPEQILEVLHEC

SEQ ID NO: 3388918 - protein, 25 aa, Plasmodium falciparum
LVSIKLNPFFYKRKVKFFDYGYYIN

SEQ ID NO: 3388919 - protein, 19 aa, Plasmodium falciparum
LVSLKIINLKYLSKKNSLK

SEQ ID NO: 3388920 - protein, 29 aa, Plasmodium falciparum
LVSNSLSFFYIYHKNYWKKCILKLQNNSY

SEQ ID NO: 3388921 - protein, 28 aa, Plasmodium falciparum
LVTRYDKNKLLFYYKRNINTSRKCLNQD

SEQ ID NO: 3388922 - protein, 25 aa, Plasmodium falciparum
LVYDIKNYLEQRLNFLVLNGIPRYR

SEQ ID NO: 3388923 - protein, 17 aa, Plasmodium falciparum
LVYKFKTWEWQEADKDR

SEQ ID NO: 3388924 - protein, 20 aa, Plasmodium falciparum
LVYNHRLQPFILKKGKEQNV

SEQ ID NO: 3388925 - protein, 19 aa, Plasmodium falciparum
LVYSPYLLERMKENYLSEG

SEQ ID NO: 3388926 - protein, 35 aa, Plasmodium falciparum
LVYSSGKICLLEKLLIRLKERGNRVLIFSQMVKML

SEQ ID NO: 3388927 - protein, 25 aa, Plasmodium falciparum
LWESPYVHRFQQKIKYHLANFKSMS

SEQ ID NO: 3388928 - protein, 32 aa, Plasmodium falciparum
LWGNYFIIENKLDPVFIFLKREGLQHDYIYQN

SEQ ID NO: 3388929 - protein, 27 aa, Plasmodium falciparum
LWHMGECRYSWRLPLTNLLSDYNMNLN

SEQ ID NO: 3388930 - protein, 28 aa, Plasmodium falciparum
LWIDEMKCYIIFLILSPYDEQQNKLSNL

SEQ ID NO: 3388931 - protein, 17 aa, Plasmodium falciparum
LWIKRQRVLRRLLKRLR

SEQ ID NO: 3388932 - protein, 17 aa, Plasmodium falciparum
LWKNYFLSWIDKHDNFN

SEQ ID NO: 3388933 - protein, 20 aa, Plasmodium falciparum
LWNCCQLQLINEGIIHEFLR

SEQ ID NO: 3388934 - protein, 41 aa, Plasmodium falciparum
LWNKKKYIKLNIFKNIILVISIVRYFLHTITISQKYTSSYD

SEQ ID NO: 3388935 - protein, 27 aa, Plasmodium falciparum
LWNNIEIHFKLTWPIALIINTNTIYTY

SEQ ID NO: 3388936 - protein, 36 aa, Plasmodium falciparum
LWNNNFYNFMKVNNFEWLGYIYFSGTSRSSLEILSD

SEQ ID NO: 3388937 - protein, 25 aa, Plasmodium falciparum
LWSYFRNPHIRLYVPECTRFYIFLE

SEQ ID NO: 3388938 - protein, 19 aa, Plasmodium falciparum
LWTGKQIFSMLLQFDDMNI

SEQ ID NO: 3388939 - protein, 27 aa, Plasmodium falciparum
LWYDKMNIIDFLKYGEYFSINKLLRKE

SEQ ID NO: 3388940 - protein, 27 aa, Plasmodium falciparum
LWYKHKRHFFIFTFSGKPVFTRYGNEE

SEQ ID NO: 3388941 - protein, 19 aa, Plasmodium falciparum
LYAAICAAPETVLDRHSLI

SEQ ID NO: 3388942 - protein, 39 aa, Plasmodium falciparum
LYAENPETVSPLTPISEIIDFIYSIFNKSTEDTITRLRE

SEQ ID NO: 3388943 - protein, 26 aa, Plasmodium falciparum
LYCGIGGLHYSLLQAFNNFVHANKIT

SEQ ID NO: 3388944 - protein, 19 aa, Plasmodium falciparum
LYCSTFDGTLLYYDMLNFR

SEQ ID NO: 3388945 - protein, 25 aa, Plasmodium falciparum
LYDKYKIIQFIFYHEIRNIHNINNH

SEQ ID NO: 3388946 - protein, 24 aa, Plasmodium falciparum
LYDSNYLTLNVNPLNYMENNLCDN

SEQ ID NO: 3388947 - protein, 17 aa, Plasmodium falciparum
LYECLKLLIKLHNVGIA

SEQ ID NO: 3388948 - protein, 20 aa, Plasmodium falciparum
LYEFYVPLYRHRPFFFTRII

SEQ ID NO: 3388949 - protein, 19 aa, Plasmodium falciparum
LYEILGVNRRAGIKEITKA

SEQ ID NO: 3388950 - protein, 27 aa, Plasmodium falciparum
LYEIYVQVILNFYFLSFNKNNKYINYI

SEQ ID NO: 3388951 - protein, 20 aa, Plasmodium falciparum
LYFAKFLFQTFNSIPYRQNY

SEQ ID NO: 3388952 - protein, 25 aa, Plasmodium falciparum
LYFDNVFINLWTKLVSKIKLLPNAN

SEQ ID NO: 3388953 - protein, 32 aa, Plasmodium falciparum
LYGNNIINNVYIYMLLNYKYLHNYHTKNNFNH

SEQ ID NO: 3388954 - protein, 33 aa, Plasmodium falciparum
LYGQSLSYNCIFFVEYFVLDLLMLNSNECIGVI

SEQ ID NO: 3388955 - protein, 27 aa, Plasmodium falciparum
LYHGCSNDFLFSAYPVFRIIRTNQFGT

SEQ ID NO: 3388956 - protein, 18 aa, Plasmodium falciparum
LYHNLRKIRKPRSYDFEY

SEQ ID NO: 3388957 - protein, 26 aa, Plasmodium falciparum
LYINCEYYEYAINMLKYFSYFECVPD

SEQ ID NO: 3388958 - protein, 30 aa, Plasmodium falciparum
LYINPSFFEIITLVAFLHFLNKKVDYAIIE

SEQ ID NO: 3388959 - protein, 19 aa, Plasmodium falciparum
LYIPRVCNPAWPFYSMINR

SEQ ID NO: 3388960 - protein, 23 aa, Plasmodium falciparum
LYITELLHNTAWYNNTLGNKLYV

SEQ ID NO: 3388961 - protein, 18 aa, Plasmodium falciparum
LYKALKEPTFFNSTSFTI

SEQ ID NO: 3388962 - protein, 26 aa, Plasmodium falciparum
LYKENDLCFIKYIIVSNFKSYEDENI

SEQ ID NO: 3388963 - protein, 20 aa, Plasmodium falciparum
LYKGKYIPVGRRIFREKLIK

SEQ ID NO: 3388964 - protein, 25 aa, Plasmodium falciparum
LYKHLLRIRILTQKVLTLSNQLPLL

SEQ ID NO: 3388965 - protein, 35 aa, Plasmodium falciparum
LYKLKDSAYYEELDYLYKLLIQKKKNILGNKYNEE

SEQ ID NO: 3388966 - protein, 24 aa, Plasmodium falciparum
LYKLSLYNHPHWIYENERCLPEDM

SEQ ID NO: 3388967 - protein, 24 aa, Plasmodium falciparum
LYKNKHHILVISRGILSKNYYKIY

SEQ ID NO: 3388968 - protein, 34 aa, Plasmodium falciparum
LYKQTQYKNLIYKWQKKLFICEIELLKNNNQILT

SEQ ID NO: 3388969 - protein, 29 aa, Plasmodium falciparum
LYLDEVSAQYFFRKIVEGLKYMHKNNIAH

SEQ ID NO: 3388970 - protein, 19 aa, Plasmodium falciparum
LYLNKNVIHIILSSLNFDE

SEQ ID NO: 3388971 - protein, 30 aa, Plasmodium falciparum
LYMKKQILFIQDYYLFQKYFKQRVKAANII

SEQ ID NO: 3388972 - protein, 25 aa, Plasmodium falciparum
LYNALVHFIHVLKKPIWGTCAGCIL

SEQ ID NO: 3388973 - protein, 22 aa, Plasmodium falciparum
LYNDLYLTPYEKNLKSSLCIGT

SEQ ID NO: 3388974 - protein, 17 aa, Plasmodium falciparum
LYNFKDKTNIENAHKEN

SEQ ID NO: 3388975 - protein, 19 aa, Plasmodium falciparum
LYNHLTMLNDFNRLHYYRA

SEQ ID NO: 3388976 - protein, 26 aa, Plasmodium falciparum
LYNIIDTLFIPYKYFLDTNLNIYAKS

SEQ ID NO: 3388977 - protein, 18 aa, Plasmodium falciparum
LYNNDNLFIILSQRINQL

SEQ ID NO: 3388978 - protein, 18 aa, Plasmodium falciparum
LYNNFDKDTLLLINQMKD

SEQ ID NO: 3388979 - protein, 30 aa, Plasmodium falciparum
LYNNFEEYFYSYFPLFLIETQQLINNKKEN

SEQ ID NO: 3388980 - protein, 22 aa, Plasmodium falciparum
LYNNLEYVNLLDIRTLENKSIY

SEQ ID NO: 3388981 - protein, 19 aa, Plasmodium falciparum
LYNNMYNMKFPYMNNDMMN

SEQ ID NO: 3388982 - protein, 23 aa, Plasmodium falciparum
LYNSNPYNMIPYNINTYNNNNNN

SEQ ID NO: 3388983 - protein, 20 aa, Plasmodium falciparum
LYNTNYYNTLCNYKKLGESK

SEQ ID NO: 3388984 - protein, 20 aa, Plasmodium falciparum
LYPHKFFLNTVKCMLAAHIY

SEQ ID NO: 3388985 - protein, 17 aa, Plasmodium falciparum
LYPKLLNFKTVLTASFP

SEQ ID NO: 3388986 - protein, 19 aa, Plasmodium falciparum
LYRCDDLICNMKYSETING

SEQ ID NO: 3388987 - protein, 18 aa, Plasmodium falciparum
LYRDYKMRYFLKKYKKKD

SEQ ID NO: 3388988 - protein, 26 aa, Plasmodium falciparum
LYRKENYYHILKILKKNLKKGGKAYF

SEQ ID NO: 3388989 - protein, 26 aa, Plasmodium falciparum
LYRKYNNIFLYTYKNYSFLWELENNI

SEQ ID NO: 3388990 - protein, 25 aa, Plasmodium falciparum
LYTAKSNTVMFPNGNYEMMHVEGRY

SEQ ID NO: 3388991 - protein, 17 aa, Plasmodium falciparum
LYTFKAVMSKTPEWIHE

SEQ ID NO: 3388992 - protein, 19 aa, Plasmodium falciparum
LYTGPLKIEQLLAKGFVKR

SEQ ID NO: 3388993 - protein, 26 aa, Plasmodium falciparum
LYTHLNFTLADFMKMNLWAVQKSFVD

SEQ ID NO: 3388994 - protein, 17 aa, Plasmodium falciparum
LYTLHKNKTYISIRSNK

SEQ ID NO: 3388995 - protein, 17 aa, Plasmodium falciparum
LYTNYYNSCEMPSPNSN

SEQ ID NO: 3388996 - protein, 17 aa, Plasmodium falciparum
LYTWYIDNKIDEKKKKN

SEQ ID NO: 3388997 - protein, 25 aa, Plasmodium falciparum
LYVIKPYICYGYIKKYNFYNLMEKR

SEQ ID NO: 3388998 - protein, 18 aa, Plasmodium falciparum
LYVRNLPYKISADELYDI

SEQ ID NO: 3388999 - protein, 21 aa, Plasmodium falciparum
LYVSMYIPFIKKFYDKRFIFY

SEQ ID NO: 3389000 - protein, 35 aa, Plasmodium falciparum
LYYNRARTLMHLNKWMDVIENCNNCLKYIPKYVNA

SEQ ID NO: 3389001 - protein, 22 aa, Plasmodium falciparum
LYYYNLKREISIKKKKLLHLNF

SEQ ID NO: 3389002 - protein, 33 aa, Plasmodium falciparum
MAKELKKRNLPFFQGLFLGQLCHIVHISTNKKI

SEQ ID NO: 3389003 - protein, 18 aa, Plasmodium falciparum
MAKRPAHLFIPIKSKEAI

SEQ ID NO: 3389004 - protein, 17 aa, Plasmodium falciparum
MALALRLKVKKKDFDNC

SEQ ID NO: 3389005 - protein, 30 aa, Plasmodium falciparum
MAQWANFMYNTCGVPFLFNQRFQNLPDFYS

SEQ ID NO: 3389006 - protein, 28 aa, Plasmodium falciparum
MATSDFLRIFGIFCYNKLIYVDKCVHKN

SEQ ID NO: 3389007 - protein, 18 aa, Plasmodium falciparum
MCDDLLSPGIDDSIERKI

SEQ ID NO: 3389008 - protein, 31 aa, Plasmodium falciparum
MCDHLMQRFGFNDFILLNDCNLCYRNFVTQK

SEQ ID NO: 3389009 - protein, 17 aa, Plasmodium falciparum
MCDYGSLCSAYILEKKV

SEQ ID NO: 3389010 - protein, 29 aa, Plasmodium falciparum
MCGIQVLANILYIFADMLSLYKNNDEAEN

SEQ ID NO: 3389011 - protein, 17 aa, Plasmodium falciparum
MCQSNNIYMKYKKNHFY

SEQ ID NO: 3389012 - protein, 32 aa, Plasmodium falciparum
MCSNTPCYFIKKKWITTFHKQWIDDIELINNQ

SEQ ID NO: 3389013 - protein, 20 aa, Plasmodium falciparum
MCTNLFSKKWIQYNDEEHKN

SEQ ID NO: 3389014 - protein, 23 aa, Plasmodium falciparum
MDADFCINYLDLRIIDDNCSLDD

SEQ ID NO: 3389015 - protein, 27 aa, Plasmodium falciparum
MDDYVKIRKYLNFLNMDDMSYQHNMSS

SEQ ID NO: 3389016 - protein, 23 aa, Plasmodium falciparum
MDEDIWLFMQNVKMKLKEDPNEM

SEQ ID NO: 3389017 - protein, 18 aa, Plasmodium falciparum
MDENLNLEFLKSSSENYT

SEQ ID NO: 3389018 - protein, 27 aa, Plasmodium falciparum
MDEREMFKYLDTLRHLPSKKGGSQYKL

SEQ ID NO: 3389019 - protein, 20 aa, Plasmodium falciparum
MDERKMLKSSKKKCLLIFIK

SEQ ID NO: 3389020 - protein, 24 aa, Plasmodium falciparum
MDETVYLFKIYNNHLYYINRQENV

SEQ ID NO: 3389021 - protein, 22 aa, Plasmodium falciparum
MDGNILIKDFIQFLNVTFDKND

SEQ ID NO: 3389022 - protein, 19 aa, Plasmodium falciparum
MDGTKYIMNDLEKCKTCME

SEQ ID NO: 3389023 - protein, 23 aa, Plasmodium falciparum
MDIKKFLNSLDILENQKKKTYIV

SEQ ID NO: 3389024 - protein, 17 aa, Plasmodium falciparum
MDIYEKEGFFNETPLNN

SEQ ID NO: 3389025 - protein, 24 aa, Plasmodium falciparum
MDKISHDAFDFIIPSSFNKEEDNG

SEQ ID NO: 3389026 - protein, 25 aa, Plasmodium falciparum
MDKKKINDCIIDRLKKYNDGHAVQV

SEQ ID NO: 3389027 - protein, 17 aa, Plasmodium falciparum
MDLNHLCYLLKYDSVHG

SEQ ID NO: 3389028 - protein, 28 aa, Plasmodium falciparum
MDNDIPKIVFKFIYPKVLPKQNNSYDCG

SEQ ID NO: 3389029 - protein, 34 aa, Plasmodium falciparum
MDNVYHLTGYLHRLLFLMKELDKKEHKINIGIER

SEQ ID NO: 3389030 - protein, 20 aa, Plasmodium falciparum
MDPMMQMDLRIQMDPRMQMD

SEQ ID NO: 3389031 - protein, 25 aa, Plasmodium falciparum
MDRYHIPRILFINKLDRDGANVERT

SEQ ID NO: 3389032 - protein, 25 aa, Plasmodium falciparum
MDSMNNLFMYNNNGNYNYLGSYGCN

SEQ ID NO: 3389033 - protein, 28 aa, Plasmodium falciparum
MDVAEIDLVWFEWPQIKIPLDDEELEVV

SEQ ID NO: 3389034 - protein, 17 aa, Plasmodium falciparum
MDVYNLIDENRNILSKL

SEQ ID NO: 3389035 - protein, 24 aa, Plasmodium falciparum
MDYKLLNKLYNLWPNNEKKERSKD

SEQ ID NO: 3389036 - protein, 24 aa, Plasmodium falciparum
MEDISFNILNYKNLCKYYLSFINF

SEQ ID NO: 3389037 - protein, 37 aa, Plasmodium falciparum
MEECLSIKPDLIFLFDEAWFAYACFHPILKFRTAMTV

SEQ ID NO: 3389038 - protein, 30 aa, Plasmodium falciparum
MEEEQFCKRRIFLNTYSLSLNGKYLCALIN

SEQ ID NO: 3389039 - protein, 26 aa, Plasmodium falciparum
MEEKSMLNWIKNTNKPYFDFVSNLKN

SEQ ID NO: 3389040 - protein, 27 aa, Plasmodium falciparum
MEEMTNPMLFFEKYNYMGLKYGALKVI

SEQ ID NO: 3389041 - protein, 26 aa, Plasmodium falciparum
MEEQKKYEQLIKQEKLKLLDKYSDDI

SEQ ID NO: 3389042 - protein, 25 aa, Plasmodium falciparum
MEHIKYDYIIGENNHYLNKSENLPR

SEQ ID NO: 3389043 - protein, 25 aa, Plasmodium falciparum
MEHQKKYIPLFSYISCIINGLKSYK

SEQ ID NO: 3389044 - protein, 24 aa, Plasmodium falciparum
MEKELPYTYALVDWIREKISSNKA

SEQ ID NO: 3389045 - protein, 27 aa, Plasmodium falciparum
MEKKKFLFFQLYMYLCNITKFKRRYVS

SEQ ID NO: 3389046 - protein, 25 aa, Plasmodium falciparum
MEKLKEKIKWLKHYNLKLLSLNESE

SEQ ID NO: 3389047 - protein, 24 aa, Plasmodium falciparum
MEKLVRTLLQCGLKPSQIGVITPY

SEQ ID NO: 3389048 - protein, 25 aa, Plasmodium falciparum
MEKQREILKRILTNKLKKREQERKM

SEQ ID NO: 3389049 - protein, 23 aa, Plasmodium falciparum
MEKYDFCFILQHTPCYTLGSVAN

SEQ ID NO: 3389050 - protein, 22 aa, Plasmodium falciparum
MENKKKQFLGNKLIDDLQKDIN

SEQ ID NO: 3389051 - protein, 38 aa, Plasmodium falciparum
MENKPKFEPFIWKQHTDLLDLCLRLLDPNPWTRIQNAR

SEQ ID NO: 3389052 - protein, 67 aa, Plasmodium falciparum
MENNNIFVYIQKKILNNFLCVELLPLFKKNLENLLLSSAQNWLMVYIHQSFYLTLNVKPIKIFKNDI

SEQ ID NO: 3389053 - protein, 23 aa, Plasmodium falciparum
MEQKDCIFLALKAIFEVVELSSK

SEQ ID NO: 3389054 - protein, 23 aa, Plasmodium falciparum
MESKHHIMFKSKSFNRNIPYEKK

SEQ ID NO: 3389055 - protein, 20 aa, Plasmodium falciparum
METKENPSSWFFGNCCTANN

SEQ ID NO: 3389056 - protein, 23 aa, Plasmodium falciparum
MEVCKDPYFFISQNFLSDLESYL

SEQ ID NO: 3389057 - protein, 22 aa, Plasmodium falciparum
MEYFTYFCDLVNKYNHNFFLYN

SEQ ID NO: 3389058 - protein, 17 aa, Plasmodium falciparum
MFAIRAMRDYVIEEDFY

SEQ ID NO: 3389059 - protein, 30 aa, Plasmodium falciparum
MFDLKEQIMIMKKKNLLLSNRLNDYDMDNI

SEQ ID NO: 3389060 - protein, 31 aa, Plasmodium falciparum
MFENFPKYIEILFDVQPNLKQLYLASICGDH

SEQ ID NO: 3389061 - protein, 17 aa, Plasmodium falciparum
MFGFTTSPYPIILSLEI

SEQ ID NO: 3389062 - protein, 21 aa, Plasmodium falciparum
MFGKIFRPPEIYMKCKYDPTK

SEQ ID NO: 3389063 - protein, 17 aa, Plasmodium falciparum
MFKKIPSQNYDTIKRES

SEQ ID NO: 3389064 - protein, 25 aa, Plasmodium falciparum
MFKRYPNFMGGYPYNNMNPYNNFNA

SEQ ID NO: 3389065 - protein, 22 aa, Plasmodium falciparum
MFLTNYKKCHHVKSYKLGKESD

SEQ ID NO: 3389066 - protein, 19 aa, Plasmodium falciparum
MFNTYQFDAILPKNSSCIL

SEQ ID NO: 3389067 - protein, 23 aa, Plasmodium falciparum
MFVKISFKLLILVLKENYEIKAK

SEQ ID NO: 3389068 - protein, 18 aa, Plasmodium falciparum
MFYKKLGNNPVHNYNKFN

SEQ ID NO: 3389069 - protein, 17 aa, Plasmodium falciparum
MGILLYGPPGCGKTMLA

SEQ ID NO: 3389070 - protein, 22 aa, Plasmodium falciparum
MGKSLCYQIPSLMDVCRKKFTI

SEQ ID NO: 3389071 - protein, 25 aa, Plasmodium falciparum
MGVQKIRFFPKYGNYLLSASLDNTL

SEQ ID NO: 3389072 - protein, 19 aa, Plasmodium falciparum
MGYCYFKKDIKEDDKKFFE

SEQ ID NO: 3389073 - protein, 31 aa, Plasmodium falciparum
MHACDSLSNDYFIPKPILLNNKNNKMATLNI

SEQ ID NO: 3389074 - protein, 26 aa, Plasmodium falciparum
MHFLDIFENFLITIKMRNNWDIYKEL

SEQ ID NO: 3389075 - protein, 17 aa, Plasmodium falciparum
MHKLPEKLNLLLYEAIA

SEQ ID NO: 3389076 - protein, 25 aa, Plasmodium falciparum
MHNHSGMHYINYKVLKKLIKYINNS

SEQ ID NO: 3389077 - protein, 18 aa, Plasmodium falciparum
MHNLCPIHYYFNGRDYNS

SEQ ID NO: 3389078 - protein, 17 aa, Plasmodium falciparum
MHPIIIKINERMINCFL

SEQ ID NO: 3389079 - protein, 24 aa, Plasmodium falciparum
MHRIKKFFFILIQSEYGDLYKIEV

SEQ ID NO: 3389080 - protein, 22 aa, Plasmodium falciparum
MHRSFRKPLIVITPKKMLKMRM

SEQ ID NO: 3389081 - protein, 32 aa, Plasmodium falciparum
MHSLIQYKEKLLLIKMPLIIKEVTYQSILNRL

SEQ ID NO: 3389082 - protein, 19 aa, Plasmodium falciparum
MHYFCEKCFIDMFQKNKKC

SEQ ID NO: 3389083 - protein, 18 aa, Plasmodium falciparum
MIDNMLFRDISGGKKRTF

SEQ ID NO: 3389084 - protein, 21 aa, Plasmodium falciparum
MIDPLMNKDNYLFCLSKYVYV

SEQ ID NO: 3389085 - protein, 29 aa, Plasmodium falciparum
MIDQTINISFPYRFDLLYNVIINVYEETH

SEQ ID NO: 3389086 - protein, 17 aa, Plasmodium falciparum
MIDYLKKQKQRALKLQD

SEQ ID NO: 3389087 - protein, 27 aa, Plasmodium falciparum
MIELPLRHPGLFKTLGVKPPRGVLLYG

SEQ ID NO: 3389088 - protein, 19 aa, Plasmodium falciparum
MIFEKYDDIRILDNISWTI

SEQ ID NO: 3389089 - protein, 17 aa, Plasmodium falciparum
MIFFIDNEDIYNYPFEL

SEQ ID NO: 3389090 - protein, 17 aa, Plasmodium falciparum
MIGYFLIRKLQEKMQFE

SEQ ID NO: 3389091 - protein, 25 aa, Plasmodium falciparum
MIHNPDFLFYRYNPFDKIITEEKYD

SEQ ID NO: 3389092 - protein, 20 aa, Plasmodium falciparum
MIHVIDDLDIPFFKTKKKKK

SEQ ID NO: 3389093 - protein, 21 aa, Plasmodium falciparum
MIKEKYFLCHKEEKIVILFFY

SEQ ID NO: 3389094 - protein, 26 aa, Plasmodium falciparum
MIKKKFSPLLFIFRRDEENEIKKYSK

SEQ ID NO: 3389095 - protein, 17 aa, Plasmodium falciparum
MIKWMELQKSCPLCKSS

SEQ ID NO: 3389096 - protein, 19 aa, Plasmodium falciparum
MILAYNNPNRAIDYLTNGF

SEQ ID NO: 3389097 - protein, 17 aa, Plasmodium falciparum
MILKPDNIMWSIIPPIM

SEQ ID NO: 3389098 - protein, 17 aa, Plasmodium falciparum
MILMSELSKRRFRSVNK

SEQ ID NO: 3389099 - protein, 23 aa, Plasmodium falciparum
MILWKNYIVMFGGFFDNGKSIEY

SEQ ID NO: 3389100 - protein, 18 aa, Plasmodium falciparum
MINLNNFNQNYIKELLIQ

SEQ ID NO: 3389101 - protein, 24 aa, Plasmodium falciparum
MINNYFYMCDIMNKIKRFTHILSI

SEQ ID NO: 3389102 - protein, 19 aa, Plasmodium falciparum
MINQGHYSDVLWPDQWTSA

SEQ ID NO: 3389103 - protein, 20 aa, Plasmodium falciparum
MINRLLLAELGRIKEDDRDH

SEQ ID NO: 3389104 - protein, 22 aa, Plasmodium falciparum
MIPKRKKVIIYAWSIKEGFIKS

SEQ ID NO: 3389105 - protein, 17 aa, Plasmodium falciparum
MIQLLQNKNIYELINEI

SEQ ID NO: 3389106 - protein, 20 aa, Plasmodium falciparum
MIQPALLQYSFDSPTPIPVL

SEQ ID NO: 3389107 - protein, 17 aa, Plasmodium falciparum
MIREIYYSFQSYNINHT

SEQ ID NO: 3389108 - protein, 36 aa, Plasmodium falciparum
MIRLTINILQNYNFLNNLKILYKKLDNKKKISLENI

SEQ ID NO: 3389109 - protein, 19 aa, Plasmodium falciparum
MIRNEYTPNQGKLIMNEND

SEQ ID NO: 3389110 - protein, 46 aa, Plasmodium falciparum
MISCDEKGIVKFWFLDKYMYKLLFTYRRTFYMKNVKFFYNVTHKNV

SEQ ID NO: 3389111 - protein, 20 aa, Plasmodium falciparum
MISEHMGIYGEQINLKKKEF

SEQ ID NO: 3389112 - protein, 18 aa, Plasmodium falciparum
MISKIKSIRFATEATITI

SEQ ID NO: 3389113 - protein, 27 aa, Plasmodium falciparum
MISNENFCFYILNKTKLLYNEKIDNIE

SEQ ID NO: 3389114 - protein, 25 aa, Plasmodium falciparum
MISPRRESINLFSSKINRTSNIYRN

SEQ ID NO: 3389115 - protein, 19 aa, Plasmodium falciparum
MKAYEWSRDYFKKKLLEDN

SEQ ID NO: 3389116 - protein, 24 aa, Plasmodium falciparum
MKCKYHLIPILKNYTLKNNSNCAI

SEQ ID NO: 3389117 - protein, 20 aa, Plasmodium falciparum
MKCRLHKIVDMKIKIKKNYI

SEQ ID NO: 3389118 - protein, 22 aa, Plasmodium falciparum
MKDGDHVFSYTKKKWLNNNNNN

SEQ ID NO: 3389119 - protein, 28 aa, Plasmodium falciparum
MKDILFLRYRYMCILNILIKYNLKYGDS

SEQ ID NO: 3389120 - protein, 22 aa, Plasmodium falciparum
MKEEYYFKKFSKMIIKKSILEE

SEQ ID NO: 3389121 - protein, 31 aa, Plasmodium falciparum
MKEKNYYYNEIKLYLKYLPESNIMITTNNYE

SEQ ID NO: 3389122 - protein, 28 aa, Plasmodium falciparum
MKENIYENSPFHTYGRPIYEKKSKNPNN

SEQ ID NO: 3389123 - protein, 25 aa, Plasmodium falciparum
MKGDLIVEFDIVFPKSLTSEKKKII

SEQ ID NO: 3389124 - protein, 24 aa, Plasmodium falciparum
MKGKYNFSYFYTKSNNLNADVQDM

SEQ ID NO: 3389125 - protein, 30 aa, Plasmodium falciparum
MKIHIDFKNIYFVKYKYIKCLVMNNSGIIV

SEQ ID NO: 3389126 - protein, 25 aa, Plasmodium falciparum
MKINQRLMLYMIMACSNKGNIKRLK

SEQ ID NO: 3389127 - protein, 22 aa, Plasmodium falciparum
MKKDIIPKNILMIGPTGVGKTE

SEQ ID NO: 3389128 - protein, 27 aa, Plasmodium falciparum
MKKEKKLFLQNIFTLKKKSLNKNTDIL

SEQ ID NO: 3389129 - protein, 32 aa, Plasmodium falciparum
MKKIQGLTFDHNQIRWIAYWKNENNKQIQKHF

SEQ ID NO: 3389130 - protein, 29 aa, Plasmodium falciparum
MKKRRFRVELLSEFLPKNPNLLGLNIVKK

SEQ ID NO: 3389131 - protein, 17 aa, Plasmodium falciparum
MKKYINNSQLLIDNFNL

SEQ ID NO: 3389132 - protein, 35 aa, Plasmodium falciparum
MKLLEIMNSKYRCRLFRMYILEAPKILKTFGKSFL

SEQ ID NO: 3389133 - protein, 28 aa, Plasmodium falciparum
MKLQRYVKLLHFIVVRIPLVYFRSANNF

SEQ ID NO: 3389134 - protein, 31 aa, Plasmodium falciparum
MKMKKTYNGVLYFLPAFNEQPPPNLDIGFFD

SEQ ID NO: 3389135 - protein, 18 aa, Plasmodium falciparum
MKNDVLCFFTLQCFTHSL

SEQ ID NO: 3389136 - protein, 33 aa, Plasmodium falciparum
MKNFISTNTYPTIFWCPLKFNDKTRILQQNTEE

SEQ ID NO: 3389137 - protein, 17 aa, Plasmodium falciparum
MKNFLMRKYLCNYHMNR

SEQ ID NO: 3389138 - protein, 25 aa, Plasmodium falciparum
MKNHNFLKYQINYPNDLISNTRKEN

SEQ ID NO: 3389139 - protein, 36 aa, Plasmodium falciparum
MKNKNPPLSISFLPYFNLSMLWQLAEDFGVYNEALK

SEQ ID NO: 3389140 - protein, 19 aa, Plasmodium falciparum
MKNLFLGNFDKILDFHITS

SEQ ID NO: 3389141 - protein, 18 aa, Plasmodium falciparum
MKNLNHINIIYLKDYYYT

SEQ ID NO: 3389142 - protein, 24 aa, Plasmodium falciparum
MKNTQMLILDKISIYKMIQIHRKN

SEQ ID NO: 3389143 - protein, 38 aa, Plasmodium falciparum
MKPEHILCYSFYINIEFFLPSAQLIIPSYLLKLTNNVH

SEQ ID NO: 3389144 - protein, 30 aa, Plasmodium falciparum
MKPYQLEGLNWLYQLYRFKINGILADEMGL

SEQ ID NO: 3389145 - protein, 17 aa, Plasmodium falciparum
MKRTIIIRRNYLHYVKK

SEQ ID NO: 3389146 - protein, 17 aa, Plasmodium falciparum
MKRYVRIKEILKRSRKL

SEQ ID NO: 3389147 - protein, 35 aa, Plasmodium falciparum
MKSQRNIWTFLFTKIFHSPLFNFTSKIKNLFLKKN

SEQ ID NO: 3389148 - protein, 30 aa, Plasmodium falciparum
MKSSEFSFRKIMDPPTRKYQNKWKPKDKRE

SEQ ID NO: 3389149 - protein, 24 aa, Plasmodium falciparum
MKTQNTFLCIYDENNKEMFDKKKK

SEQ ID NO: 3389150 - protein, 24 aa, Plasmodium falciparum
MKTQWIFFVSKIYKDTRYTDILGH

SEQ ID NO: 3389151 - protein, 25 aa, Plasmodium falciparum
MKYSLLYELMFITRSPYIINKFLLS

SEQ ID NO: 3389152 - protein, 27 aa, Plasmodium falciparum
MLCFEKQFKYIYDIYKQNDKNVFLFYN

SEQ ID NO: 3389153 - protein, 17 aa, Plasmodium falciparum
MLELLNQLDGFDSRGDV

SEQ ID NO: 3389154 - protein, 17 aa, Plasmodium falciparum
MLEQNREKINIVLNEEM

SEQ ID NO: 3389155 - protein, 19 aa, Plasmodium falciparum
MLGKLLMSDMKSLFTDTIY

SEQ ID NO: 3389156 - protein, 23 aa, Plasmodium falciparum
MLIKRMHRMLIKGTILDSNNICT

SEQ ID NO: 3389157 - protein, 20 aa, Plasmodium falciparum
MLLALNNKIELLQNDLKLVI

SEQ ID NO: 3389158 - protein, 18 aa, Plasmodium falciparum
MLLSRMKLYRVKKSLLLI

SEQ ID NO: 3389159 - protein, 19 aa, Plasmodium falciparum
MLMFGLRSLSDFCNPTSKA

SEQ ID NO: 3389160 - protein, 19 aa, Plasmodium falciparum
MLNFLNTFPKKGKFQHTYI

SEQ ID NO: 3389161 - protein, 37 aa, Plasmodium falciparum
MLNIELYTHIYPKLCHNFLYLCEYKYYNKSDIFKKQD

SEQ ID NO: 3389162 - protein, 38 aa, Plasmodium falciparum
MLNIELYTHIYPKLCHNFLYLCEYKYYNKSDIFKKQDD

SEQ ID NO: 3389163 - protein, 36 aa, Plasmodium falciparum
MLNIYCPKIIILFIPQNIYLQLYISSLICLHLKNYK

SEQ ID NO: 3389164 - protein, 17 aa, Plasmodium falciparum
MLNIYKINKDDYLHTDI

SEQ ID NO: 3389165 - protein, 20 aa, Plasmodium falciparum
MLNKNINIIYYNDEYKNIIF

SEQ ID NO: 3389166 - protein, 26 aa, Plasmodium falciparum
MLNKRSYFSIYNFFISLRKGGESTLK

SEQ ID NO: 3389167 - protein, 19 aa, Plasmodium falciparum
MLNMYYVCIDYIKLQDDKI

SEQ ID NO: 3389168 - protein, 42 aa, Plasmodium falciparum
MLNNFSLQNSKFLWHEKVKSRWIYLLSNNWDFFKNISSISTS

SEQ ID NO: 3389169 - protein, 26 aa, Plasmodium falciparum
MLNNISTESLPFQKKSFMCCVNCFDT

SEQ ID NO: 3389170 - protein, 26 aa, Plasmodium falciparum
MLPEEELVEFIFLLLKERNEYNNLEK

SEQ ID NO: 3389171 - protein, 17 aa, Plasmodium falciparum
MLPLEADISEIKHIIKK

SEQ ID NO: 3389172 - protein, 19 aa, Plasmodium falciparum
MLPMVTKKALPKSKALPIL

SEQ ID NO: 3389173 - protein, 22 aa, Plasmodium falciparum
MLQVIYEFIFLCIRIYDDDIII

SEQ ID NO: 3389174 - protein, 26 aa, Plasmodium falciparum
MLSSLSNYYYFINKNYYSNVFFKLFK

SEQ ID NO: 3389175 - protein, 25 aa, Plasmodium falciparum
MLTSKFINGILLGKLFIYKNINEHK

SEQ ID NO: 3389176 - protein, 20 aa, Plasmodium falciparum
MLTYKYLLNIHTILMYPKLF

SEQ ID NO: 3389177 - protein, 17 aa, Plasmodium falciparum
MMELLNQLDGFESTQNI

SEQ ID NO: 3389178 - protein, 21 aa, Plasmodium falciparum
MMEYYTNMLNFLKDEKILNKI

SEQ ID NO: 3389179 - protein, 20 aa, Plasmodium falciparum
MMKLNKYMTCNDKNIGAIEN

SEQ ID NO: 3389180 - protein, 36 aa, Plasmodium falciparum
MMKRGKSGKWLWLSPDWKPRWLKKKSKLILEEEWKC

SEQ ID NO: 3389181 - protein, 33 aa, Plasmodium falciparum
MMNSLRGYYMNNDFFRFFPNRRSLTDYDINRNR

SEQ ID NO: 3389182 - protein, 27 aa, Plasmodium falciparum
MNATVWVTLTDFVLYLGKTGKCKIEQT

SEQ ID NO: 3389183 - protein, 25 aa, Plasmodium falciparum
MNDDKFFLYSKKFIKRKTRKTFKSN

SEQ ID NO: 3389184 - protein, 26 aa, Plasmodium falciparum
MNDIDLKICIFSWKKTEKSKKKNKIR

SEQ ID NO: 3389185 - protein, 29 aa, Plasmodium falciparum
MNDINDLKYLALIPKLEYINGAVKLLNKE

SEQ ID NO: 3389186 - protein, 26 aa, Plasmodium falciparum
MNDKGLFSRIKKEYLRKIKFSEKNEE

SEQ ID NO: 3389187 - protein, 19 aa, Plasmodium falciparum
MNDLFLGKHDNMLRTDEIP

SEQ ID NO: 3389188 - protein, 22 aa, Plasmodium falciparum
MNDNLISTHLRLNIYPDGGINT

SEQ ID NO: 3389189 - protein, 19 aa, Plasmodium falciparum
MNDNMYYNIAPFCHETTPA

SEQ ID NO: 3389190 - protein, 27 aa, Plasmodium falciparum
MNDTYTFYIPDLKYVTNVKKILLTIGK

SEQ ID NO: 3389191 - protein, 38 aa, Plasmodium falciparum
MNEDVKWISFHGCYDFAYLLKILTCSALPHNEAAFFEL

SEQ ID NO: 3389192 - protein, 28 aa, Plasmodium falciparum
MNEHFKGLYDFFYLPIDFRNKCNVGYAF

SEQ ID NO: 3389193 - protein, 23 aa, Plasmodium falciparum
MNEHFSYFVISEFLNLMRLCKRG

SEQ ID NO: 3389194 - protein, 39 aa, Plasmodium falciparum
MNEIPRNFYCLPQIDNLLIWDVFIMLYSTVYKNAKLKLQ

SEQ ID NO: 3389195 - protein, 25 aa, Plasmodium falciparum
MNELEPYLELFSECIKNSKLPSHMS

SEQ ID NO: 3389196 - protein, 24 aa, Plasmodium falciparum
MNELLGKIFYFIPDPNDMASWISR

SEQ ID NO: 3389197 - protein, 24 aa, Plasmodium falciparum
MNELNHATFIKTNQSNFIKGNNKE

SEQ ID NO: 3389198 - protein, 18 aa, Plasmodium falciparum
MNELYILKKEKEDIYKEY

SEQ ID NO: 3389199 - protein, 18 aa, Plasmodium falciparum
MNFNIMEYLMSDNYIHIN

SEQ ID NO: 3389200 - protein, 25 aa, Plasmodium falciparum
MNHFNEGDFYFDKGKMGSTMGNIEN

SEQ ID NO: 3389201 - protein, 18 aa, Plasmodium falciparum
MNHLKTNVIAKFRQSFLI

SEQ ID NO: 3389202 - protein, 27 aa, Plasmodium falciparum
MNIDPCDIIIKPLLYNSGHSYQMIKIN

SEQ ID NO: 3389203 - protein, 36 aa, Plasmodium falciparum
MNIKDFLLLLLIYYKNKVFLLPQLLIKILSIVNNGK

SEQ ID NO: 3389204 - protein, 42 aa, Plasmodium falciparum
MNIKGKSLLLNNVHLKNISLYKAVLLKLQLICNRCCNTFDVT

SEQ ID NO: 3389205 - protein, 24 aa, Plasmodium falciparum
MNIKNYEFLYNNLKIRNDMIRNND

SEQ ID NO: 3389206 - protein, 18 aa, Plasmodium falciparum
MNILNLTDTFPEHSNIDI

SEQ ID NO: 3389207 - protein, 24 aa, Plasmodium falciparum
MNINEFLCFFYSIVLHDLLPYQML

SEQ ID NO: 3389208 - protein, 29 aa, Plasmodium falciparum
MNIQKNYVLSFKDYIWKSISSSAKDLISK

SEQ ID NO: 3389209 - protein, 30 aa, Plasmodium falciparum
MNKLFTQIIKGILYFQPYVSKNAKHLLQNM

SEQ ID NO: 3389210 - protein, 24 aa, Plasmodium falciparum
MNKYSLNEPFWFLIDFEKCNMSSY

SEQ ID NO: 3389211 - protein, 31 aa, Plasmodium falciparum
MNLQGFLNFLSNFIIYFKINLSNMSIGKNPL

SEQ ID NO: 3389212 - protein, 26 aa, Plasmodium falciparum
MNLRDNCIVCFKYLKIGEWQGKKLES

SEQ ID NO: 3389213 - protein, 26 aa, Plasmodium falciparum
MNLTEEQKMFFLKQLNIKDEEFIEPN

SEQ ID NO: 3389214 - protein, 23 aa, Plasmodium falciparum
MNMPNVKTYLLLLSRFYECTYET

SEQ ID NO: 3389215 - protein, 18 aa, Plasmodium falciparum
MNMYKNNTFFVKGRYSNN

SEQ ID NO: 3389216 - protein, 26 aa, Plasmodium falciparum
MNNDNEMFYRNILSSSWASHNNNGLL

SEQ ID NO: 3389217 - protein, 20 aa, Plasmodium falciparum
MNNGIFDNIFFISAKYNKGI

SEQ ID NO: 3389218 - protein, 30 aa, Plasmodium falciparum
MNNIKSEIILKSDKFILNSYDNIIEEKKNL

SEQ ID NO: 3389219 - protein, 19 aa, Plasmodium falciparum
MNNLSKYIYYWIDSNDKNV

SEQ ID NO: 3389220 - protein, 23 aa, Plasmodium falciparum
MNNLYILRNERIPIFGKNFLDLI

SEQ ID NO: 3389221 - protein, 25 aa, Plasmodium falciparum
MNNTFIYNTTYEPLLNRNMNIYNIT

SEQ ID NO: 3389222 - protein, 24 aa, Plasmodium falciparum
MNPKYKNFYIQKIKGLLYANLDED

SEQ ID NO: 3389223 - protein, 17 aa, Plasmodium falciparum
MNPLHLNRWYKFLEMYE

SEQ ID NO: 3389224 - protein, 23 aa, Plasmodium falciparum
MNPTLLCSIIYSLIKGNCLLQYD

SEQ ID NO: 3389225 - protein, 21 aa, Plasmodium falciparum
MNRFVAVCKKVCLYKPIILLK

SEQ ID NO: 3389226 - protein, 19 aa, Plasmodium falciparum
MNRFYDNNTLWKKQQRNMM

SEQ ID NO: 3389227 - protein, 46 aa, Plasmodium falciparum
MNSHSEINMLINNFIYILKIMNKHKQMLENIYTINFTNIDDICVRN

SEQ ID NO: 3389228 - protein, 27 aa, Plasmodium falciparum
MNSSDIKNFLNLLHLKNSGSFNEQNFL

SEQ ID NO: 3389229 - protein, 25 aa, Plasmodium falciparum
MNTEENIILKYKKIHKNNLMHDNHM

SEQ ID NO: 3389230 - protein, 21 aa, Plasmodium falciparum
MNTFAYCSLNYDTIPLHLFMS

SEQ ID NO: 3389231 - protein, 29 aa, Plasmodium falciparum
MNTGYIPNNNFLYNNKLCYDESGKIFIRG

SEQ ID NO: 3389232 - protein, 23 aa, Plasmodium falciparum
MNTNSVHDYVIPNDLYNVENINV

SEQ ID NO: 3389233 - protein, 26 aa, Plasmodium falciparum
MNTRRSIMVDNLRKPPLASSSNRLIS

SEQ ID NO: 3389234 - protein, 23 aa, Plasmodium falciparum
MNTSSYNEHFKYIIKNYIKNKNK

SEQ ID NO: 3389235 - protein, 33 aa, Plasmodium falciparum
MNVGLVFRKYIPILINLSCNYLLIKKNEKNVIT

SEQ ID NO: 3389236 - protein, 24 aa, Plasmodium falciparum
MNVKKYHDLFIKYDAFNTIANSEK

SEQ ID NO: 3389237 - protein, 17 aa, Plasmodium falciparum
MNYIHKCKKKRVLCLDT

SEQ ID NO: 3389238 - protein, 28 aa, Plasmodium falciparum
MNYTDFRQMYWDLLKQIKKKYYPTKNFK

SEQ ID NO: 3389239 - protein, 27 aa, Plasmodium falciparum
MPDNEEILSNLLFLYNSNMNNSMNKMS

SEQ ID NO: 3389240 - protein, 17 aa, Plasmodium falciparum
MPGSSHLILKYKKTMMS

SEQ ID NO: 3389241 - protein, 18 aa, Plasmodium falciparum
MPLLQKLTHDFVTFTMSC

SEQ ID NO: 3389242 - protein, 24 aa, Plasmodium falciparum
MPNKLTKCFILVLNVSLEYEKSEV

SEQ ID NO: 3389243 - protein, 25 aa, Plasmodium falciparum
MPTTGIVYLQFVFSLDHLTVDELAY

SEQ ID NO: 3389244 - protein, 18 aa, Plasmodium falciparum
MQKKMKYAFDVTSIDFEN

SEQ ID NO: 3389245 - protein, 24 aa, Plasmodium falciparum
MQLRNIFFEYIKKKFLLHGAVEID

SEQ ID NO: 3389246 - protein, 22 aa, Plasmodium falciparum
MQLYNFGQIVSIPYFEDNYKPT

SEQ ID NO: 3389247 - protein, 31 aa, Plasmodium falciparum
MQNELHIVVFSQWIGFLKIIEKLLNLYNIAN

SEQ ID NO: 3389248 - protein, 17 aa, Plasmodium falciparum
MQNKLLKEKILQIETFI

SEQ ID NO: 3389249 - protein, 19 aa, Plasmodium falciparum
MQSEKFIRNTSLSLDGVEL

SEQ ID NO: 3389250 - protein, 19 aa, Plasmodium falciparum
MQSSFCRFSNIKTKAYDII

SEQ ID NO: 3389251 - protein, 20 aa, Plasmodium falciparum
MRELKLWSLKNTTSPLTTIT

SEQ ID NO: 3389252 - protein, 24 aa, Plasmodium falciparum
MREYDIHLLKLYNKLESNERKSKL

SEQ ID NO: 3389253 - protein, 19 aa, Plasmodium falciparum
MRIAYMESMLQKCEKDLSK

SEQ ID NO: 3389254 - protein, 27 aa, Plasmodium falciparum
MRIKKPSFIQFLFRPHPKSLFNDKLKL

SEQ ID NO: 3389255 - protein, 28 aa, Plasmodium falciparum
MRKTKQPLLYIIYKLKKLNYNNNNNNNN

SEQ ID NO: 3389256 - protein, 23 aa, Plasmodium falciparum
MRKYSLELLIYFLEHFNKYKKEC

SEQ ID NO: 3389257 - protein, 20 aa, Plasmodium falciparum
MRLYHLPHPTIYPKGTTPIL

SEQ ID NO: 3389258 - protein, 35 aa, Plasmodium falciparum
MRSHYINTIKHEISLYLEMYPEEVAKLFVKVKQWK

SEQ ID NO: 3389259 - protein, 32 aa, Plasmodium falciparum
MRTKLTEETPNSLKYMINLKNETLSNAEFESV

SEQ ID NO: 3389260 - protein, 26 aa, Plasmodium falciparum
MRVRDLLLVIIYKQVEPMLYKFIYDT

SEQ ID NO: 3389261 - protein, 18 aa, Plasmodium falciparum
MSDHANFYKLKYSSYDKY

SEQ ID NO: 3389262 - protein, 18 aa, Plasmodium falciparum
MSDKIKNRLLYDENFENN

SEQ ID NO: 3389263 - protein, 21 aa, Plasmodium falciparum
MSIDFEPFRPINTSLYLCDNK

SEQ ID NO: 3389264 - protein, 23 aa, Plasmodium falciparum
MSIENLHWLILFTPEEGIKKNVI

SEQ ID NO: 3389265 - protein, 24 aa, Plasmodium falciparum
MSIENLHWLILFTPEEGIKKNVIK

SEQ ID NO: 3389266 - protein, 30 aa, Plasmodium falciparum
MSKTYEKGDFFYIPRFSNFQIINDSRYIKN

SEQ ID NO: 3389267 - protein, 23 aa, Plasmodium falciparum
MSKYIDNNFLIYKSDIFNEKPNV

SEQ ID NO: 3389268 - protein, 25 aa, Plasmodium falciparum
MSLKAKLTHFLSNQPLTISSDYSDT

SEQ ID NO: 3389269 - protein, 22 aa, Plasmodium falciparum
MSMPIIIYLIKRIFKENYPIYN

SEQ ID NO: 3389270 - protein, 21 aa, Plasmodium falciparum
MSNFYSLIKFPYQDILNISKN

SEQ ID NO: 3389271 - protein, 26 aa, Plasmodium falciparum
MSPEDLKIHNLPISRIKKIMKEDDEI

SEQ ID NO: 3389272 - protein, 27 aa, Plasmodium falciparum
MSPQMMYNPMYYPYYNMNNMHPSSAPY

SEQ ID NO: 3389273 - protein, 18 aa, Plasmodium falciparum
MSQSPYFLKNLRTEKYSL

SEQ ID NO: 3389274 - protein, 32 aa, Plasmodium falciparum
MSRSIRLMENGLKPIYVFDGAPPELKGSELEK

SEQ ID NO: 3389275 - protein, 39 aa, Plasmodium falciparum
MSTTLYNNFDIIKFIMKWIFVHVIKIFVKDTYMLYINNN

SEQ ID NO: 3389276 - protein, 27 aa, Plasmodium falciparum
MSVENYMGYPYYYSQYYNVGPHQSNAI

SEQ ID NO: 3389277 - protein, 24 aa, Plasmodium falciparum
MSYEMNITHIFNLLENNEILTLYI

SEQ ID NO: 3389278 - protein, 27 aa, Plasmodium falciparum
MSYGTLHKSNPLLWGKDYKNHYELPTI

SEQ ID NO: 3389279 - protein, 19 aa, Plasmodium falciparum
MSYLYSKMLPFKYIISCYI

SEQ ID NO: 3389280 - protein, 27 aa, Plasmodium falciparum
MTEATKSICYLLWNDYARIEKYMNVVN

SEQ ID NO: 3389281 - protein, 29 aa, Plasmodium falciparum
MTEILFEKYNIPALYFAKKAKLTSFSLGR

SEQ ID NO: 3389282 - protein, 52 aa, Plasmodium falciparum
MTENKTFCLSILPFHYKYTSRLYPIERPKYFYYVIHLFNAHVQSVAAFTGHI

SEQ ID NO: 3389283 - protein, 19 aa, Plasmodium falciparum
MTIPIIKKKNLLSEMKRKL

SEQ ID NO: 3389284 - protein, 24 aa, Plasmodium falciparum
MTNNNYIDIKLYKDLVKENKSLEN

SEQ ID NO: 3389285 - protein, 23 aa, Plasmodium falciparum
MTNNQLSIFLYILEKWNMIDNYK

SEQ ID NO: 3389286 - protein, 20 aa, Plasmodium falciparum
MTPIQSNMHIPVISRRETKP

SEQ ID NO: 3389287 - protein, 22 aa, Plasmodium falciparum
MTSKYIPTFYKKEAGICIGFGG

SEQ ID NO: 3389288 - protein, 27 aa, Plasmodium falciparum
MTTIQKYSIPVILKKINLLACSQTGSG

SEQ ID NO: 3389289 - protein, 27 aa, Plasmodium falciparum
MTTNRSIEFWFKLIDLDADCVIRDHEI

SEQ ID NO: 3389290 - protein, 32 aa, Plasmodium falciparum
MTVNYRKKIIQFIRNNIYINSYIYDCFENKYT

SEQ ID NO: 3389291 - protein, 25 aa, Plasmodium falciparum
MTWNDLISSVLFRNISRKDKLQYSL

SEQ ID NO: 3389292 - protein, 18 aa, Plasmodium falciparum
MVEKPEIWKKMISGSLYP

SEQ ID NO: 3389293 - protein, 21 aa, Plasmodium falciparum
MVERALSSSLYFDNKQKGKES

SEQ ID NO: 3389294 - protein, 17 aa, Plasmodium falciparum
MVFDIFKCNNEKKEIGI

SEQ ID NO: 3389295 - protein, 27 aa, Plasmodium falciparum
MVGDLRITFINWLKKTQMNFIREKDKL

SEQ ID NO: 3389296 - protein, 37 aa, Plasmodium falciparum
MVHDMPARLNLRKIIYKYLILELFTNAQSCNFLTCIE

SEQ ID NO: 3389297 - protein, 17 aa, Plasmodium falciparum
MVHLKINVQNRMNLFIP

SEQ ID NO: 3389298 - protein, 26 aa, Plasmodium falciparum
MVIEGPLLICQILESVILNLMNYPTL

SEQ ID NO: 3389299 - protein, 23 aa, Plasmodium falciparum
MVIKSLFNHLFYQGTILLCTSNR

SEQ ID NO: 3389300 - protein, 18 aa, Plasmodium falciparum
MVKVITPGPFYNEIGKII

SEQ ID NO: 3389301 - protein, 25 aa, Plasmodium falciparum
MVNNENIKRILYNKALTTANIGHTH

SEQ ID NO: 3389302 - protein, 38 aa, Plasmodium falciparum
MVNTNLSLHKMFYFYKNYIVYMDPYYSTYINIHNNINC

SEQ ID NO: 3389303 - protein, 20 aa, Plasmodium falciparum
MVRELFQMAKSKKACILFID

SEQ ID NO: 3389304 - protein, 29 aa, Plasmodium falciparum
MVVIKKFLPKPILMQINSIQYILPVPVNS

SEQ ID NO: 3389305 - protein, 17 aa, Plasmodium falciparum
MVWVYNIKENFWIKARR

SEQ ID NO: 3389306 - protein, 18 aa, Plasmodium falciparum
MYANMMNIQNVNGGTIKG

SEQ ID NO: 3389307 - protein, 22 aa, Plasmodium falciparum
MYDEDWNPFIDLQAIDRAHRIG

SEQ ID NO: 3389308 - protein, 18 aa, Plasmodium falciparum
MYFDLNDNAYINVKGNLY

SEQ ID NO: 3389309 - protein, 17 aa, Plasmodium falciparum
MYFYMSHPNIRSFSLPW

SEQ ID NO: 3389310 - protein, 18 aa, Plasmodium falciparum
MYGSYYINFLSYVSQENF

SEQ ID NO: 3389311 - protein, 27 aa, Plasmodium falciparum
MYHFKILHNLFFQTIKYIYPKKNNFTY

SEQ ID NO: 3389312 - protein, 18 aa, Plasmodium falciparum
MYIKRLFNKLTVDKLLKA

SEQ ID NO: 3389313 - protein, 26 aa, Plasmodium falciparum
MYKDKVKFLLLEECNYLKELRNVIEE

SEQ ID NO: 3389314 - protein, 19 aa, Plasmodium falciparum
MYLFLGYSHGNIEYFIMCA

SEQ ID NO: 3389315 - protein, 19 aa, Plasmodium falciparum
MYLLKNKSLNRNGSILSNL

SEQ ID NO: 3389316 - protein, 26 aa, Plasmodium falciparum
MYMNKKPQILPFFYTDYDLTNLLKEQ

SEQ ID NO: 3389317 - protein, 25 aa, Plasmodium falciparum
MYNNMNGRLLNNMNNVNLINAEPYK

SEQ ID NO: 3389318 - protein, 17 aa, Plasmodium falciparum
MYQKKSSFLFNKNNFHM

SEQ ID NO: 3389319 - protein, 25 aa, Plasmodium falciparum
MYTHKYTHYEIYKSMFAYGKIAQMR

SEQ ID NO: 3389320 - protein, 17 aa, Plasmodium falciparum
MYTILNDYTYYFSVDMV

SEQ ID NO: 3389321 - protein, 24 aa, Plasmodium falciparum
MYTNFFLLRFIFEYESYMSENYPN

SEQ ID NO: 3389322 - protein, 27 aa, Plasmodium falciparum
MYTRINDLCLLHLHNCPWRNNLMDISI

SEQ ID NO: 3389323 - protein, 20 aa, Plasmodium falciparum
MYVDILDALFKNKFLEIFQN

SEQ ID NO: 3389324 - protein, 26 aa, Plasmodium falciparum
MYYEDVNIYYYYLKNNLLNTYNNNNN

SEQ ID NO: 3389325 - protein, 19 aa, Plasmodium falciparum
NACLFISMKYHRLRSNYLK

SEQ ID NO: 3389326 - protein, 18 aa, Plasmodium falciparum
NACRLVGSIYFRCLKNNF

SEQ ID NO: 3389327 - protein, 26 aa, Plasmodium falciparum
NAEKSPFLCERLKIWCIPTVMLIQNG

SEQ ID NO: 3389328 - protein, 32 aa, Plasmodium falciparum
NAELKSKAMLQLIYWHKWLTEEEKDQEEEIDE

SEQ ID NO: 3389329 - protein, 22 aa, Plasmodium falciparum
NAENLPINFELNTEPWKNAEYE

SEQ ID NO: 3389330 - protein, 24 aa, Plasmodium falciparum
NAEPYKNILSDNNNLKYLSFNKSA

SEQ ID NO: 3389331 - protein, 37 aa, Plasmodium falciparum
NAESWTPICLPIYNPNLFLYAYINYIKKKICCVYICS

SEQ ID NO: 3389332 - protein, 19 aa, Plasmodium falciparum
NAFFKNMFSSVHAKVFNYF

SEQ ID NO: 3389333 - protein, 22 aa, Plasmodium falciparum
NAFKIIRRLCCPRKKKDIDLLF

SEQ ID NO: 3389334 - protein, 33 aa, Plasmodium falciparum
NAFPPNMPKLPTNMPFLPPNMPILPPHLQHMPN

SEQ ID NO: 3389335 - protein, 29 aa, Plasmodium falciparum
NAFSLPVNIYINKLSFFSIKDELFVKENL

SEQ ID NO: 3389336 - protein, 17 aa, Plasmodium falciparum
NAGFKELKKKVGRDKTK

SEQ ID NO: 3389337 - protein, 21 aa, Plasmodium falciparum
NAIKCLNNKIILSGAHKPLEV

SEQ ID NO: 3389338 - protein, 17 aa, Plasmodium falciparum
NAKASLIWIIGEYVERI

SEQ ID NO: 3389339 - protein, 31 aa, Plasmodium falciparum
NAKKNMGCYFLLDVLMKTINYYKTYNKLKTC

SEQ ID NO: 3389340 - protein, 20 aa, Plasmodium falciparum
NAKLSDFGLSAMILGKKSHS

SEQ ID NO: 3389341 - protein, 25 aa, Plasmodium falciparum
NAKTTLKYYILNKLKWKVLTIEYMD

SEQ ID NO: 3389342 - protein, 25 aa, Plasmodium falciparum
NALARRHISWPMLFEVSNPYTDKRT

SEQ ID NO: 3389343 - protein, 20 aa, Plasmodium falciparum
NALGLPDSLLTPVLKKVDKK

SEQ ID NO: 3389344 - protein, 27 aa, Plasmodium falciparum
NALLDEKSKMPLLCNYTNVSKSLYHIF

SEQ ID NO: 3389345 - protein, 26 aa, Plasmodium falciparum
NALTLSQLYIILRSLNIYLNMQILYH

SEQ ID NO: 3389346 - protein, 21 aa, Plasmodium falciparum
NALYSLLERLSNYKYKQYKDK

SEQ ID NO: 3389347 - protein, 23 aa, Plasmodium falciparum
NANALYLYALQIFKICNIHNELP

SEQ ID NO: 3389348 - protein, 33 aa, Plasmodium falciparum
NANDFLNFKYGFPYFWINALVEKPYSLSEKNEL

SEQ ID NO: 3389349 - protein, 27 aa, Plasmodium falciparum
NANKFEPFFFVLFGDIQYGMIRGNHGW

SEQ ID NO: 3389350 - protein, 24 aa, Plasmodium falciparum
NANKKFYQIIDKPIIKKKRKTTTS

SEQ ID NO: 3389351 - protein, 29 aa, Plasmodium falciparum
NANMYQIKNRAFDIYLNESTKNRIETDKN

SEQ ID NO: 3389352 - protein, 22 aa, Plasmodium falciparum
NANRKNNMVLEQKLYDNKSTES

SEQ ID NO: 3389353 - protein, 20 aa, Plasmodium falciparum
NANYKFVDVLLGSLSSRINL

SEQ ID NO: 3389354 - protein, 21 aa, Plasmodium falciparum
NANYREIYGSYILAKTNLDDT

SEQ ID NO: 3389355 - protein, 23 aa, Plasmodium falciparum
NAPHPYKNSVLMNPSRKTRNSKN

SEQ ID NO: 3389356 - protein, 25 aa, Plasmodium falciparum
NAQGNINITPIINSILRLDNEVDNV

SEQ ID NO: 3389357 - protein, 32 aa, Plasmodium falciparum
NAQLSLFEAFIIYHFWYQKNSVDIKKNFRNFL

SEQ ID NO: 3389358 - protein, 26 aa, Plasmodium falciparum
NAQNIRFCINFFTAIGLGALTSSLRK

SEQ ID NO: 3389359 - protein, 17 aa, Plasmodium falciparum
NAQYARYLYYIGKILAV

SEQ ID NO: 3389360 - protein, 23 aa, Plasmodium falciparum
NAREALLACLINPQILSVVIVDN

SEQ ID NO: 3389361 - protein, 28 aa, Plasmodium falciparum
NARILEAIKMRWIKIYEQKLRNKELGLV

SEQ ID NO: 3389362 - protein, 17 aa, Plasmodium falciparum
NARNHMFGIQISKSTIL

SEQ ID NO: 3389363 - protein, 23 aa, Plasmodium falciparum
NASDLILPLSIYVANNGSSKSLS

SEQ ID NO: 3389364 - protein, 19 aa, Plasmodium falciparum
NASKNFTLQFFKKGQAIIK

SEQ ID NO: 3389365 - protein, 36 aa, Plasmodium falciparum
NASRILSNTLGISNKYIRNLHFPSIDSHTVSNFLDA

SEQ ID NO: 3389366 - protein, 23 aa, Plasmodium falciparum
NASSKFLLYNSKGDNHLNYNNNI

SEQ ID NO: 3389367 - protein, 22 aa, Plasmodium falciparum
NATLSYIQYLLNFDYELRPSIE

SEQ ID NO: 3389368 - protein, 26 aa, Plasmodium falciparum
NAVLSPLLLILYNISVNIPATIHSFM

SEQ ID NO: 3389369 - protein, 19 aa, Plasmodium falciparum
NAWKYTEEGKRRTLQRQDV

SEQ ID NO: 3389370 - protein, 27 aa, Plasmodium falciparum
NAYINNPEFPFKKLNIEKIEKIRKSVS

SEQ ID NO: 3389371 - protein, 17 aa, Plasmodium falciparum
NAYSYSYNWIYLEKKKI

SEQ ID NO: 3389372 - protein, 24 aa, Plasmodium falciparum
NCAYHDLIKLFYFKGHKQREKCNK

SEQ ID NO: 3389373 - protein, 23 aa, Plasmodium falciparum
NCDENFIRILKSILVNNKSINVQ

SEQ ID NO: 3389374 - protein, 19 aa, Plasmodium falciparum
NCDLFAFPLKCKMHLLNNS

SEQ ID NO: 3389375 - protein, 24 aa, Plasmodium falciparum
NCDYDLYNVILYFNNKQINGLMKI

SEQ ID NO: 3389376 - protein, 23 aa, Plasmodium falciparum
NCEIYKNLLYNFKDKTNIENAHK

SEQ ID NO: 3389377 - protein, 17 aa, Plasmodium falciparum
NCFKNYYLKLYDEITNL

SEQ ID NO: 3389378 - protein, 26 aa, Plasmodium falciparum
NCFSSKYFLFFSDELNLWQKKISNIY

SEQ ID NO: 3389379 - protein, 42 aa, Plasmodium falciparum
NCGVQFSKIFYIYNPLSIWIKDLCIFNFILTNNNFKFLASDH

SEQ ID NO: 3389380 - protein, 25 aa, Plasmodium falciparum
NCIFSHDYQLFYCRNNVIYNSCHNP

SEQ ID NO: 3389381 - protein, 35 aa, Plasmodium falciparum
NCINLFIHDYIYLLLLPPISYHPLAYELILHKPDK

SEQ ID NO: 3389382 - protein, 24 aa, Plasmodium falciparum
NCIQRTYVYFFINKNYNIEKMKKA

SEQ ID NO: 3389383 - protein, 26 aa, Plasmodium falciparum
NCIWRFRFQLLNRKETLGKFLKSINW

SEQ ID NO: 3389384 - protein, 27 aa, Plasmodium falciparum
NCKDEKYIHMLMKNFNMYSNDLLNFDY

SEQ ID NO: 3389385 - protein, 44 aa, Plasmodium falciparum
NCKENILNLIKNKNLSVQDILYYQKLLLCLKYVGDHNSAINNNE

SEQ ID NO: 3389386 - protein, 23 aa, Plasmodium falciparum
NCKKLRLLELGYNKIRMIENIEH

SEQ ID NO: 3389387 - protein, 19 aa, Plasmodium falciparum
NCKSLLLEVDNLKFILNDL

SEQ ID NO: 3389388 - protein, 27 aa, Plasmodium falciparum
NCLLQYDLLIVLTKLSIIFLEEFKYSE

SEQ ID NO: 3389389 - protein, 30 aa, Plasmodium falciparum
NCLPELEVFFYLLILLYLLDEKCYDEGMEL

SEQ ID NO: 3389390 - protein, 20 aa, Plasmodium falciparum
NCMVNNNLDIYEFSCKSEGG

SEQ ID NO: 3389391 - protein, 35 aa, Plasmodium falciparum
NCNEACNIAPTFWLFFGLQSYYNYKYYRNTCISIH

SEQ ID NO: 3389392 - protein, 27 aa, Plasmodium falciparum
NCNIEIPVYPVHFRDFLKKRTFNNKQD

SEQ ID NO: 3389393 - protein, 26 aa, Plasmodium falciparum
NCNVGMLNLTFPFNNSCKDEKILTTK

SEQ ID NO: 3389394 - protein, 27 aa, Plasmodium falciparum
NCNYKPNYNYFINKDLLNNNMTYIYNY

SEQ ID NO: 3389395 - protein, 29 aa, Plasmodium falciparum
NCPNIKNYAIFFKYIKDASHFYDTHIKNN

SEQ ID NO: 3389396 - protein, 18 aa, Plasmodium falciparum
NCQLYWENMNPRKYVSIV

SEQ ID NO: 3389397 - protein, 24 aa, Plasmodium falciparum
NCSEITLFPARTFPIQRFFFVNEY

SEQ ID NO: 3389398 - protein, 37 aa, Plasmodium falciparum
NCSVCNNMMIFLLQIYAPLDELGNCFHRCLYVFICIH

SEQ ID NO: 3389399 - protein, 18 aa, Plasmodium falciparum
NCTLYIDEPRYKVDMTKY

SEQ ID NO: 3389400 - protein, 25 aa, Plasmodium falciparum
NCVIKNLINIKYFNNIILSSLKKVH

SEQ ID NO: 3389401 - protein, 33 aa, Plasmodium falciparum
NCVKKYCINILGLWVIKSKYLYKFLRGKQDKKE

SEQ ID NO: 3389402 - protein, 24 aa, Plasmodium falciparum
NCWKEVMWRLGIPELHYYNSVRND

SEQ ID NO: 3389403 - protein, 17 aa, Plasmodium falciparum
NCYFCSLVSKNIHIKRI

SEQ ID NO: 3389404 - protein, 26 aa, Plasmodium falciparum
NCYNICNDMFFGNNDIYDIFSNFNSL

SEQ ID NO: 3389405 - protein, 26 aa, Plasmodium falciparum
NDAKDKILKYMKKANRPYSVINVYDN

SEQ ID NO: 3389406 - protein, 24 aa, Plasmodium falciparum
NDCGYYCYPIDALFVFISIIYNNY

SEQ ID NO: 3389407 - protein, 26 aa, Plasmodium falciparum
NDDEIFTYYMSLKNNLPNIKNINNIK

SEQ ID NO: 3389408 - protein, 20 aa, Plasmodium falciparum
NDDFLIHDKELLSHILNSNS

SEQ ID NO: 3389409 - protein, 25 aa, Plasmodium falciparum
NDDIIKLWIAHKRNELIIPYHEKCI

SEQ ID NO: 3389410 - protein, 24 aa, Plasmodium falciparum
NDDILLILDRSIDTSILFIHDYSY

SEQ ID NO: 3389411 - protein, 24 aa, Plasmodium falciparum
NDDILYLEFLDKFEKRFITQNTYE

SEQ ID NO: 3389412 - protein, 24 aa, Plasmodium falciparum
NDDKNYVFFEGLIVKINLETHEFY

SEQ ID NO: 3389413 - protein, 33 aa, Plasmodium falciparum
NDDLQENILIQNQNYFPKMFQYEINESERYLTF

SEQ ID NO: 3389414 - protein, 24 aa, Plasmodium falciparum
NDDMNFYIMNAELLKFENINLKNT

SEQ ID NO: 3389415 - protein, 24 aa, Plasmodium falciparum
NDDNYTHMLNTNKSFNKLKGEYDE

SEQ ID NO: 3389416 - protein, 28 aa, Plasmodium falciparum
NDDVDGYMRQLVDLYLKSQKSKSKNLGS

SEQ ID NO: 3389417 - protein, 25 aa, Plasmodium falciparum
NDEDELILKLLPDLKKKSKLEPPPP

SEQ ID NO: 3389418 - protein, 17 aa, Plasmodium falciparum
NDEDLFLKKSKVGNALN

SEQ ID NO: 3389419 - protein, 19 aa, Plasmodium falciparum
NDEEQVSYFDFRNHMKSYY

SEQ ID NO: 3389420 - protein, 24 aa, Plasmodium falciparum
NDEFIFFQMESLKKGLLDLLIYGD

SEQ ID NO: 3389421 - protein, 20 aa, Plasmodium falciparum
NDEIFIDNNKIESYQLNMLN

SEQ ID NO: 3389422 - protein, 26 aa, Plasmodium falciparum
NDEIIKILKYKIFNLEKLLKIKDSKI

SEQ ID NO: 3389423 - protein, 27 aa, Plasmodium falciparum
NDEIINNYFLFLKDKWILPNEYQIFKM

SEQ ID NO: 3389424 - protein, 33 aa, Plasmodium falciparum
NDEKVQDVGFFLPFYRKLLKKYETINNVVINND

SEQ ID NO: 3389425 - protein, 26 aa, Plasmodium falciparum
NDERGKFYPFLFFPRFGVGRDRSGLG

SEQ ID NO: 3389426 - protein, 21 aa, Plasmodium falciparum
NDETFLQYITINDIYNIINMN

SEQ ID NO: 3389427 - protein, 35 aa, Plasmodium falciparum
NDETTQMLNAFVPFDLDPPPLYAENPETVSPLTPI

SEQ ID NO: 3389428 - protein, 26 aa, Plasmodium falciparum
NDFKEYPIHFTYRNEKKNSSKNAFLI

SEQ ID NO: 3389429 - protein, 21 aa, Plasmodium falciparum
NDFKNLLGWVPRNLKISECTN

SEQ ID NO: 3389430 - protein, 19 aa, Plasmodium falciparum
NDFLLKRNIMLYRNFKNIN

SEQ ID NO: 3389431 - protein, 23 aa, Plasmodium falciparum
NDFRIEKNYLKDIFFSCIGFGNK

SEQ ID NO: 3389432 - protein, 20 aa, Plasmodium falciparum
NDFRKIKIYLKKYKKCKLTL

SEQ ID NO: 3389433 - protein, 35 aa, Plasmodium falciparum
NDGCVSLLSVHALKNIVLKLYHLRIVEMQQNVYKN

SEQ ID NO: 3389434 - protein, 31 aa, Plasmodium falciparum
NDGHAVQVDIYQRSFKKAYQTNFNYKNTYDN

SEQ ID NO: 3389435 - protein, 25 aa, Plasmodium falciparum
NDGICEYEIPFLLDYVDDSNKEDSE

SEQ ID NO: 3389436 - protein, 33 aa, Plasmodium falciparum
NDGKKIVCEEPFSFFRRHDCWNNEYNCLHQQER

SEQ ID NO: 3389437 - protein, 24 aa, Plasmodium falciparum
NDGRFITFIFQICPNISCVTIKNN

SEQ ID NO: 3389438 - protein, 18 aa, Plasmodium falciparum
NDHLLYYKKHSHSKEDIH

SEQ ID NO: 3389439 - protein, 23 aa, Plasmodium falciparum
NDHNLSHTLSKYDNFVLSDNNND

SEQ ID NO: 3389440 - protein, 24 aa, Plasmodium falciparum
NDHPFIIRLVRTFKDSKYFYFLTE

SEQ ID NO: 3389441 - protein, 28 aa, Plasmodium falciparum
NDICNALKKYLKPLYIKVSIVAKHLCIN

SEQ ID NO: 3389442 - protein, 26 aa, Plasmodium falciparum
NDIDICRMWFEQVFSYNTRVYIEYEK

SEQ ID NO: 3389443 - protein, 39 aa, Plasmodium falciparum
NDIEKLKFKIKKYNNIPIFYFRKLFKYIIEQNNNNNNNN

SEQ ID NO: 3389444 - protein, 24 aa, Plasmodium falciparum
NDIFYKFINIDYFSILIANTPNII

SEQ ID NO: 3389445 - protein, 24 aa, Plasmodium falciparum
NDIHRLLTYLPSNRRNILLSATLG

SEQ ID NO: 3389446 - protein, 18 aa, Plasmodium falciparum
NDIILALSKLKKTDEEIL

SEQ ID NO: 3389447 - protein, 30 aa, Plasmodium falciparum
NDIKTFYLSYMYKYIQYVLKKREYPINFNY

SEQ ID NO: 3389448 - protein, 20 aa, Plasmodium falciparum
NDIKWCIELLSDILSNSIFD

SEQ ID NO: 3389449 - protein, 17 aa, Plasmodium falciparum
NDILISKQKIEDLKKSI

SEQ ID NO: 3389450 - protein, 17 aa, Plasmodium falciparum
NDILLNNLPIDNYVLCN

SEQ ID NO: 3389451 - protein, 31 aa, Plasmodium falciparum
NDINPHMPQYIIKAPWYLNQTKPGLKHQRYK

SEQ ID NO: 3389452 - protein, 26 aa, Plasmodium falciparum
NDIQEKLIYLTDKELDITIKLKNIKH

SEQ ID NO: 3389453 - protein, 18 aa, Plasmodium falciparum
NDIRNLMLFFTSLTNINV

SEQ ID NO: 3389454 - protein, 19 aa, Plasmodium falciparum
NDITLVRTLAKDLVKIKQN

SEQ ID NO: 3389455 - protein, 24 aa, Plasmodium falciparum
NDITPHQLGLPNIIPSGIIKHQNN

SEQ ID NO: 3389456 - protein, 33 aa, Plasmodium falciparum
NDIVANNILFHKRLRHINILSYKGKTADKSKLY

SEQ ID NO: 3389457 - protein, 19 aa, Plasmodium falciparum
NDIVLGILELLKYHARVMY

SEQ ID NO: 3389458 - protein, 18 aa, Plasmodium falciparum
NDKANGYGILLYNNGNKY

SEQ ID NO: 3389459 - protein, 23 aa, Plasmodium falciparum
NDKDAYFKLIEKFDRMYSIINDF

SEQ ID NO: 3389460 - protein, 26 aa, Plasmodium falciparum
NDKEKELFQYLILKAINEIEQISTKL

SEQ ID NO: 3389461 - protein, 30 aa, Plasmodium falciparum
NDKENMKFCKWGRNIFARRLRGATFPETHD

SEQ ID NO: 3389462 - protein, 22 aa, Plasmodium falciparum
NDKFYNNIYMNSPINYSVEYSE

SEQ ID NO: 3389463 - protein, 28 aa, Plasmodium falciparum
NDKHNCNYRLIIVALHKGKTYNYENSSF

SEQ ID NO: 3389464 - protein, 21 aa, Plasmodium falciparum
NDKIIVFSDNIFALLHIAKTL

SEQ ID NO: 3389465 - protein, 17 aa, Plasmodium falciparum
NDKIKIFISWCPEIVED

SEQ ID NO: 3389466 - protein, 25 aa, Plasmodium falciparum
NDKIMYQPIFFLPENFSGTVVHNEF

SEQ ID NO: 3389467 - protein, 25 aa, Plasmodium falciparum
NDKINILSSVKYFNKPIQFNQINWN

SEQ ID NO: 3389468 - protein, 25 aa, Plasmodium falciparum
NDKKFSHHYYRNNSYKYKNSHNHNF

SEQ ID NO: 3389469 - protein, 23 aa, Plasmodium falciparum
NDKKKNLHYFKKNKMNNTFNSNR

SEQ ID NO: 3389470 - protein, 26 aa, Plasmodium falciparum
NDKKKYNKLLFLKEKKKKKYTFFSVA

SEQ ID NO: 3389471 - protein, 23 aa, Plasmodium falciparum
NDKKRLTYKNEKYNKYAILKDKG

SEQ ID NO: 3389472 - protein, 24 aa, Plasmodium falciparum
NDKLKYIHISNINKKIKRAMMNKQ

SEQ ID NO: 3389473 - protein, 22 aa, Plasmodium falciparum
NDKLNLYLYIKKIINSYRSYFH

SEQ ID NO: 3389474 - protein, 29 aa, Plasmodium falciparum
NDKNEAHINWTIWEKKWDKWRNNIDHILT

SEQ ID NO: 3389475 - protein, 25 aa, Plasmodium falciparum
NDKNIEHNFLYFSETFWNEVSEKLS

SEQ ID NO: 3389476 - protein, 25 aa, Plasmodium falciparum
NDKNILKLFFITKGCNGLTHSFNFI

SEQ ID NO: 3389477 - protein, 24 aa, Plasmodium falciparum
NDKNVFLFYNPPVCKCVNKNLKEQ

SEQ ID NO: 3389478 - protein, 31 aa, Plasmodium falciparum
NDKQLYYLMSLLNEIHDIFYIMLEQFKRKET

SEQ ID NO: 3389479 - protein, 21 aa, Plasmodium falciparum
NDKRKIGLFKSLKNSKKEDIN

SEQ ID NO: 3389480 - protein, 28 aa, Plasmodium falciparum
NDKTIVEYLFLNKIIQILICTSTLAWGI

SEQ ID NO: 3389481 - protein, 21 aa, Plasmodium falciparum
NDKYLNTYYASPRGNQIYNLF

SEQ ID NO: 3389482 - protein, 24 aa, Plasmodium falciparum
NDLEKEYLYLKKSLSKTSTKKHLI

SEQ ID NO: 3389483 - protein, 19 aa, Plasmodium falciparum
NDLHLRRRKEESSISTFIK

SEQ ID NO: 3389484 - protein, 20 aa, Plasmodium falciparum
NDLITILKSLGFNISCQIFD

SEQ ID NO: 3389485 - protein, 26 aa, Plasmodium falciparum
NDLITPFLIVFIRPFILKKEINSDDI

SEQ ID NO: 3389486 - protein, 25 aa, Plasmodium falciparum
NDLKFLLYEFFCPYGNIIDINIKKS

SEQ ID NO: 3389487 - protein, 24 aa, Plasmodium falciparum
NDMKMLWDEISLPSLDNILKEYKL

SEQ ID NO: 3389488 - protein, 55 aa, Plasmodium falciparum
NDMNNYATCYEIYIRNLHIDITKEEIYNLFDGYRIKRINILNKKGKTAAAYVEFD

SEQ ID NO: 3389489 - protein, 21 aa, Plasmodium falciparum
NDMTLEEGLLLALKTLAKSTD

SEQ ID NO: 3389490 - protein, 25 aa, Plasmodium falciparum
NDMVKMLEIFGNVIKWQRQRNPSTN

SEQ ID NO: 3389491 - protein, 19 aa, Plasmodium falciparum
NDMYQNLSYLFRIDYGINK

SEQ ID NO: 3389492 - protein, 23 aa, Plasmodium falciparum
NDNCYGYIYKNKSSTLDESLKHQ

SEQ ID NO: 3389493 - protein, 24 aa, Plasmodium falciparum
NDNDIYLIFDFMETDLHEVIKADL

SEQ ID NO: 3389494 - protein, 26 aa, Plasmodium falciparum
NDNEEKIHFLKFPNGLLDNDKKKELK

SEQ ID NO: 3389495 - protein, 27 aa, Plasmodium falciparum
NDNELLHLIPFFLNLRKLKDIRSLCSF

SEQ ID NO: 3389496 - protein, 20 aa, Plasmodium falciparum
NDNILASKEVKPFLGSSEKT

SEQ ID NO: 3389497 - protein, 31 aa, Plasmodium falciparum
NDNKKKMFDLQSLVLLLYSSTCLITCTEQMT

SEQ ID NO: 3389498 - protein, 24 aa, Plasmodium falciparum
NDNKRNYFSKYKYDKDYNYNNNDK

SEQ ID NO: 3389499 - protein, 19 aa, Plasmodium falciparum
NDNLFIILSQRINQLIEQA

SEQ ID NO: 3389500 - protein, 23 aa, Plasmodium falciparum
NDNMRNNHIIDYIINYMVNNMVN

SEQ ID NO: 3389501 - protein, 30 aa, Plasmodium falciparum
NDNNKYEYIKSFLYSLRNNHINFEIMNRFL

SEQ ID NO: 3389502 - protein, 23 aa, Plasmodium falciparum
NDNNLNDPFFNYQHMNYANNNND

SEQ ID NO: 3389503 - protein, 25 aa, Plasmodium falciparum
NDNNTPYMLYNNLSRRNRNSMNYHH

SEQ ID NO: 3389504 - protein, 20 aa, Plasmodium falciparum
NDNNYLCMDTIMSTSNNSHS

SEQ ID NO: 3389505 - protein, 30 aa, Plasmodium falciparum
NDNRNFRRKDIDLEINWRNTANPTQEENNN

SEQ ID NO: 3389506 - protein, 28 aa, Plasmodium falciparum
NDNTREIRRYFSVKQYGFEQARILAVKA

SEQ ID NO: 3389507 - protein, 24 aa, Plasmodium falciparum
NDNVLPLYLLELFSIPIEQKEKND

SEQ ID NO: 3389508 - protein, 29 aa, Plasmodium falciparum
NDNYYKLPWVHRGISKYLLIKNKNFDDIL

SEQ ID NO: 3389509 - protein, 22 aa, Plasmodium falciparum
NDPNYRYKMPKLISKIEGRGNG

SEQ ID NO: 3389510 - protein, 20 aa, Plasmodium falciparum
NDQFFIKKLYESIKRRFHFL

SEQ ID NO: 3389511 - protein, 26 aa, Plasmodium falciparum
NDQNKYPIMLTWKPHLRYVNNSTQIV

SEQ ID NO: 3389512 - protein, 25 aa, Plasmodium falciparum
NDRKRKQVENFERALKIKKKKENVN

SEQ ID NO: 3389513 - protein, 25 aa, Plasmodium falciparum
NDRWNHLKEKYFDMMKPGVVDNIIN

SEQ ID NO: 3389514 - protein, 29 aa, Plasmodium falciparum
NDSCDYTNNLLNIFLSCNSINENFDDANE

SEQ ID NO: 3389515 - protein, 24 aa, Plasmodium falciparum
NDSGMITSLKFFDNIKFLSTGLDK

SEQ ID NO: 3389516 - protein, 20 aa, Plasmodium falciparum
NDSIFYYKNILRKYFHYVKK

SEQ ID NO: 3389517 - protein, 25 aa, Plasmodium falciparum
NDTEKSIITYLYKYGHLYNEHALSK

SEQ ID NO: 3389518 - protein, 21 aa, Plasmodium falciparum
NDTFQYDLYEKYFIANANEDY

SEQ ID NO: 3389519 - protein, 22 aa, Plasmodium falciparum
NDTNIIFNKLNSNHLHNGDYAF

SEQ ID NO: 3389520 - protein, 19 aa, Plasmodium falciparum
NDTPNYFLNSYIDKNLDPI

SEQ ID NO: 3389521 - protein, 24 aa, Plasmodium falciparum
NDTQYILNKKTARILYIYNMTNEY

SEQ ID NO: 3389522 - protein, 34 aa, Plasmodium falciparum
NDTSLLKKRKIINDILLNIKKKMKKNDTLCIICL

SEQ ID NO: 3389523 - protein, 22 aa, Plasmodium falciparum
NDTYRYLFNERILNKECIYLND

SEQ ID NO: 3389524 - protein, 33 aa, Plasmodium falciparum
NDVDKDSFFIIFEKAWKLFFHDDTKGKKLLLHE

SEQ ID NO: 3389525 - protein, 24 aa, Plasmodium falciparum
NDVERALYLLKMEYNYMISEDECM

SEQ ID NO: 3389526 - protein, 32 aa, Plasmodium falciparum
NDVIQQIIKTSFILWLRYEYDQDAALFMNTYK

SEQ ID NO: 3389527 - protein, 23 aa, Plasmodium falciparum
NDVKLMSYAYIKNKMNLGFSSFR

SEQ ID NO: 3389528 - protein, 19 aa, Plasmodium falciparum
NDVLYKKVKPPFKPKLFNQ

SEQ ID NO: 3389529 - protein, 33 aa, Plasmodium falciparum
NDVNYWNMILCKIPYYKSKYILKCFQEKLQKGL

SEQ ID NO: 3389530 - protein, 27 aa, Plasmodium falciparum
NDVSPIELVLFLPALCRLKEVPYCIVK

SEQ ID NO: 3389531 - protein, 26 aa, Plasmodium falciparum
NDVVSDNFLVIKKYTAKYEVQIDPFN

SEQ ID NO: 3389532 - protein, 23 aa, Plasmodium falciparum
NDWIKNFCWFCSLHILDEILEKQ

SEQ ID NO: 3389533 - protein, 24 aa, Plasmodium falciparum
NDYAKNFLTFLKGSFEKVAEEIQI

SEQ ID NO: 3389534 - protein, 20 aa, Plasmodium falciparum
NDYEYFGNLGLQKGLHENNI

SEQ ID NO: 3389535 - protein, 25 aa, Plasmodium falciparum
NDYFKNEIIILINGILRNNKDGKCF

SEQ ID NO: 3389536 - protein, 34 aa, Plasmodium falciparum
NDYKGKRIFSRLEILNINIVKLNYLDKLGEYIDS

SEQ ID NO: 3389537 - protein, 25 aa, Plasmodium falciparum
NDYKNYFFFNKIVKRKIRLEKNKEH

SEQ ID NO: 3389538 - protein, 18 aa, Plasmodium falciparum
NDYWKKEAYNYHNKLKIL

SEQ ID NO: 3389539 - protein, 18 aa, Plasmodium falciparum
NDYYCMDDYKSLISNEQS

SEQ ID NO: 3389540 - protein, 19 aa, Plasmodium falciparum
NDYYSQILIDSLENNNNSN

SEQ ID NO: 3389541 - protein, 26 aa, Plasmodium falciparum
NEAFLNGYLYFSRIGHNINLLLNELS

SEQ ID NO: 3389542 - protein, 25 aa, Plasmodium falciparum
NEAIVKYKEALDFFIHTEEWDDQIL

SEQ ID NO: 3389543 - protein, 23 aa, Plasmodium falciparum
NEALYDICFRTLKLTTPTYGDLN

SEQ ID NO: 3389544 - protein, 22 aa, Plasmodium falciparum
NEAYKKNLNFLLQKSSMNNNNM

SEQ ID NO: 3389545 - protein, 23 aa, Plasmodium falciparum
NEAYQILDIFYYIGDIMKEMMEG

SEQ ID NO: 3389546 - protein, 22 aa, Plasmodium falciparum
NEAYRHEGYRHEGYRHEGYLSR

SEQ ID NO: 3389547 - protein, 21 aa, Plasmodium falciparum
NECIKVCQLFLLSSKIVDKFS

SEQ ID NO: 3389548 - protein, 23 aa, Plasmodium falciparum
NECKLFIHIYETLRILYFNFYSY

SEQ ID NO: 3389549 - protein, 45 aa, Plasmodium falciparum
NECVINKGLWIYDSLFFMIIRKDGYLDFWNLLYNFNQPIIKHKIC

SEQ ID NO: 3389550 - protein, 23 aa, Plasmodium falciparum
NEDFSLIILLLLKDLDNHVRSII

SEQ ID NO: 3389551 - protein, 30 aa, Plasmodium falciparum
NEDFVYLRALGIFYLRLIGKSLEVYNHLEP

SEQ ID NO: 3389552 - protein, 23 aa, Plasmodium falciparum
NEDGVFSFFKNMNLFRELNKSNN

SEQ ID NO: 3389553 - protein, 25 aa, Plasmodium falciparum
NEDIKIVLMNIQKMLKKTGMSIDII

SEQ ID NO: 3389554 - protein, 26 aa, Plasmodium falciparum
NEDIRVDLISGYILDIAGKGAENYKN

SEQ ID NO: 3389555 - protein, 24 aa, Plasmodium falciparum
NEDPVHFALCEYLNCFKKNNLSIK

SEQ ID NO: 3389556 - protein, 21 aa, Plasmodium falciparum
NEDQIIFDDKLNDIGLHNNQD

SEQ ID NO: 3389557 - protein, 24 aa, Plasmodium falciparum
NEEAKYFELLISSSKNNIQPYEQP

SEQ ID NO: 3389558 - protein, 17 aa, Plasmodium falciparum
NEECFYLHELGNVIDSF

SEQ ID NO: 3389559 - protein, 31 aa, Plasmodium falciparum
NEEDALKLYKRGCIPLIIKNAFLECCKDNSI

SEQ ID NO: 3389560 - protein, 27 aa, Plasmodium falciparum
NEEEDFILYYPLYFKSIYNKSTDNIVE

SEQ ID NO: 3389561 - protein, 24 aa, Plasmodium falciparum
NEEEKLAFQLLLSKLNQDTHFELF

SEQ ID NO: 3389562 - protein, 25 aa, Plasmodium falciparum
NEEERCFLTLLKNSILKNPKKWTNI

SEQ ID NO: 3389563 - protein, 26 aa, Plasmodium falciparum
NEEFIKKLKFLFYFNCINLDNKINDK

SEQ ID NO: 3389564 - protein, 21 aa, Plasmodium falciparum
NEEICKCKDLCLIFDQKKIEL

SEQ ID NO: 3389565 - protein, 23 aa, Plasmodium falciparum
NEEIIRLKGEINKISLLYSNELN

SEQ ID NO: 3389566 - protein, 50 aa, Plasmodium falciparum
NEEIYTQLLPNVYRLIDLIKFKNDKYKICFYYIIKETLLANSLEQAHVIA

SEQ ID NO: 3389567 - protein, 25 aa, Plasmodium falciparum
NEEKDHLKCLLEEYSKTLEIYKMGK

SEQ ID NO: 3389568 - protein, 26 aa, Plasmodium falciparum
NEEKNNYIGFNKFLITPAIVQKNIAN

SEQ ID NO: 3389569 - protein, 27 aa, Plasmodium falciparum
NEEKYICLKFRDSHVRKFVLNNQLDNK

SEQ ID NO: 3389570 - protein, 24 aa, Plasmodium falciparum
NEENIPQIYFNNHPFINVNMKRSM

SEQ ID NO: 3389571 - protein, 27 aa, Plasmodium falciparum
NEENKKFYNVFVKKVRDKYFKHVTNKN

SEQ ID NO: 3389572 - protein, 27 aa, Plasmodium falciparum
NEENTETLYLMRPFHAILNEIENAEKE

SEQ ID NO: 3389573 - protein, 28 aa, Plasmodium falciparum
NEEPKLINHFLYLMDNYKLNCIKEYGML

SEQ ID NO: 3389574 - protein, 30 aa, Plasmodium falciparum
NEEQYPTNIIKEHKLFFQVMETNEQEYVDE

SEQ ID NO: 3389575 - protein, 23 aa, Plasmodium falciparum
NEERKVLHFWNRSPGARYPKKAN

SEQ ID NO: 3389576 - protein, 21 aa, Plasmodium falciparum
NEEVYKIFSVEKYDMLKKEVG

SEQ ID NO: 3389577 - protein, 23 aa, Plasmodium falciparum
NEEYFHTKWNFKNSLHLLSYKEN

SEQ ID NO: 3389578 - protein, 18 aa, Plasmodium falciparum
NEEYYKNIKLYNRFMENN

SEQ ID NO: 3389579 - protein, 19 aa, Plasmodium falciparum
NEFFLRTKDHWLKELNKIS

SEQ ID NO: 3389580 - protein, 26 aa, Plasmodium falciparum
NEFKKREHVYLACISSLEKEVCRIHT

SEQ ID NO: 3389581 - protein, 26 aa, Plasmodium falciparum
NEFKNNLTEQLLFFKSAENINTSGSF

SEQ ID NO: 3389582 - protein, 19 aa, Plasmodium falciparum
NEFLKKYKNFYSPTDLTII

SEQ ID NO: 3389583 - protein, 41 aa, Plasmodium falciparum
NEFNDIAFQLCPWKKGIQWNLLKKMWTCKLWDNKGNEITKN

SEQ ID NO: 3389584 - protein, 19 aa, Plasmodium falciparum
NEGFLIRSFKRIKHKIKGD

SEQ ID NO: 3389585 - protein, 20 aa, Plasmodium falciparum
NEGKVIEQFLPFSANDPNVT

SEQ ID NO: 3389586 - protein, 19 aa, Plasmodium falciparum
NEHFMPVNNVPFKKRGSDL

SEQ ID NO: 3389587 - protein, 26 aa, Plasmodium falciparum
NEHIKKFVIILPPPNVTGTLHIGHTL

SEQ ID NO: 3389588 - protein, 32 aa, Plasmodium falciparum
NEHKITYICKGLFYYYWLCYSMEEQKKCSLKI

SEQ ID NO: 3389589 - protein, 23 aa, Plasmodium falciparum
NEHKKQYNIPRNNTLRLLDEQKE

SEQ ID NO: 3389590 - protein, 24 aa, Plasmodium falciparum
NEHNAYMIMYYFQQLNKLNDDDDF

SEQ ID NO: 3389591 - protein, 26 aa, Plasmodium falciparum
NEHRAYHSMICANNYIFIIGGEEYNY

SEQ ID NO: 3389592 - protein, 18 aa, Plasmodium falciparum
NEICEDLIFLFGDILEEK

SEQ ID NO: 3389593 - protein, 23 aa, Plasmodium falciparum
NEIDIKVCTLINCPTHNPQNYVK

SEQ ID NO: 3389594 - protein, 18 aa, Plasmodium falciparum
NEIIILVYIFQIYDIFKN

SEQ ID NO: 3389595 - protein, 20 aa, Plasmodium falciparum
NEIKFLNEIFSFVVRSMDYN

SEQ ID NO: 3389596 - protein, 23 aa, Plasmodium falciparum
NEIKHGIYKIVYCSPEYALNNKD

SEQ ID NO: 3389597 - protein, 30 aa, Plasmodium falciparum
NEIKKLQFLNEFYKIYFEKYNKWKVVIINN

SEQ ID NO: 3389598 - protein, 23 aa, Plasmodium falciparum
NEIKKYCPFVKNIQFLYNTNEKK

SEQ ID NO: 3389599 - protein, 17 aa, Plasmodium falciparum
NEIKRIQSVPLIIGQFL

SEQ ID NO: 3389600 - protein, 24 aa, Plasmodium falciparum
NEILYMGVSIFFKNKFFEEYKMNN

SEQ ID NO: 3389601 - protein, 19 aa, Plasmodium falciparum
NEINELLIEIIYITLTREN

SEQ ID NO: 3389602 - protein, 30 aa, Plasmodium falciparum
NEINKLYVIIKTCDNPFYIVKFTIYEKNVQ

SEQ ID NO: 3389603 - protein, 27 aa, Plasmodium falciparum
NEINMWCPYLRNHKIIYYGSQSERRYL

SEQ ID NO: 3389604 - protein, 53 aa, Plasmodium falciparum
NEIPYIVFHKSYLIFPPFNINMLWDIYELDQSWYKTFIKIRKLRCRLKRLSKA

SEQ ID NO: 3389605 - protein, 26 aa, Plasmodium falciparum
NEIRIPLIIGRQYLFYSLNFAHSVTV

SEQ ID NO: 3389606 - protein, 36 aa, Plasmodium falciparum
NEISFLLSQIRIYIKEIDILLRLDINKNTNTTTISI

SEQ ID NO: 3389607 - protein, 28 aa, Plasmodium falciparum
NEISTIRNFIKIINKWKKVDSNILINIV

SEQ ID NO: 3389608 - protein, 32 aa, Plasmodium falciparum
NEIVELGYYFYIINIFFLLVKKNTVYKNITHI

SEQ ID NO: 3389609 - protein, 27 aa, Plasmodium falciparum
NEIVIRPIMYLALTYDHRLLDGREAVQ

SEQ ID NO: 3389610 - protein, 39 aa, Plasmodium falciparum
NEIYENKIKLQKHIALLELIKYVILYSNTNIKKENTEII

SEQ ID NO: 3389611 - protein, 19 aa, Plasmodium falciparum
NEIYLFTAIAPYTINVWIF

SEQ ID NO: 3389612 - protein, 30 aa, Plasmodium falciparum
NEKAKNLFNLSRLTGITSTTIPGACTVCNH

SEQ ID NO: 3389613 - protein, 44 aa, Plasmodium falciparum
NEKDAFFLNYYKYIQIKLHDILGALFILRRCALYPELSKYIIHL

SEQ ID NO: 3389614 - protein, 28 aa, Plasmodium falciparum
NEKDEAYIVQIIKYIEKLKEQDKIFGIN

SEQ ID NO: 3389615 - protein, 20 aa, Plasmodium falciparum
NEKDIILKLMYNNNGIYFDD

SEQ ID NO: 3389616 - protein, 28 aa, Plasmodium falciparum
NEKDYELDFLCLAVLIYEMCTKYNSYYS

SEQ ID NO: 3389617 - protein, 26 aa, Plasmodium falciparum
NEKEKYVKLEFLYDEIKQKYDLLQKK

SEQ ID NO: 3389618 - protein, 21 aa, Plasmodium falciparum
NEKFFILEYFADTDSIVLHDK

SEQ ID NO: 3389619 - protein, 32 aa, Plasmodium falciparum
NEKIDPIHIYISYYKYIYGKLRNRDKSYKNLL

SEQ ID NO: 3389620 - protein, 25 aa, Plasmodium falciparum
NEKIKYICDILLNISYFNISKNHRK

SEQ ID NO: 3389621 - protein, 17 aa, Plasmodium falciparum
NEKILVKYFQTEKKRFG

SEQ ID NO: 3389622 - protein, 41 aa, Plasmodium falciparum
NEKISNLYKCLLCRKLYTEPVTLHCCAETYCKACLYKYNKK

SEQ ID NO: 3389623 - protein, 30 aa, Plasmodium falciparum
NEKKEIGIDDFIFVFKQLHINIKKHVINKI

SEQ ID NO: 3389624 - protein, 24 aa, Plasmodium falciparum
NEKKEMSYFEWLANEKKKKEIIEK

SEQ ID NO: 3389625 - protein, 17 aa, Plasmodium falciparum
NEKKIICIFLQYIKYQS

SEQ ID NO: 3389626 - protein, 19 aa, Plasmodium falciparum
NEKKINIILKKIGASYFGD

SEQ ID NO: 3389627 - protein, 18 aa, Plasmodium falciparum
NEKKKCIYWFINYVTDMN

SEQ ID NO: 3389628 - protein, 25 aa, Plasmodium falciparum
NEKKKDIILLNEYEYFFTNTDDYTQ

SEQ ID NO: 3389629 - protein, 23 aa, Plasmodium falciparum
NEKKKLYINGNKNIFLSNKNSEK

SEQ ID NO: 3389630 - protein, 23 aa, Plasmodium falciparum
NEKKLYFFDICKHKICGECLENH

SEQ ID NO: 3389631 - protein, 27 aa, Plasmodium falciparum
NEKLHKDILFIILTTDKLFDNHKELFL

SEQ ID NO: 3389632 - protein, 25 aa, Plasmodium falciparum
NEKLKKKKVFFKSEADLNNSFLNSY

SEQ ID NO: 3389633 - protein, 19 aa, Plasmodium falciparum
NEKNCVFKYFLDVKETSHK

SEQ ID NO: 3389634 - protein, 28 aa, Plasmodium falciparum
NEKNENLYLLYLYYKYYYMNDKENVLNE

SEQ ID NO: 3389635 - protein, 28 aa, Plasmodium falciparum
NEKNEYFLLKRFLEHIRLLKIHIFVTYN

SEQ ID NO: 3389636 - protein, 25 aa, Plasmodium falciparum
NEKNKKEFFFFDDDKDKVLLEKNIL

SEQ ID NO: 3389637 - protein, 24 aa, Plasmodium falciparum
NEKNNLSYDLNLSSLPSSNMNKNL

SEQ ID NO: 3389638 - protein, 32 aa, Plasmodium falciparum
NEKNPFLHELDVKYYLRIPMSTGWNHFGYLKN

SEQ ID NO: 3389639 - protein, 24 aa, Plasmodium falciparum
NEKPPIYLMGLSLGVNIALRTLEI

SEQ ID NO: 3389640 - protein, 22 aa, Plasmodium falciparum
NEKRINSMTLIFKNGDNNWKYL

SEQ ID NO: 3389641 - protein, 22 aa, Plasmodium falciparum
NEKRLCYMNPYIDITNMNALLN

SEQ ID NO: 3389642 - protein, 20 aa, Plasmodium falciparum
NEKRNNFLHMYHNHIITPTE

SEQ ID NO: 3389643 - protein, 26 aa, Plasmodium falciparum
NEKVIKINEKRWLIATKHVKIERVNK

SEQ ID NO: 3389644 - protein, 17 aa, Plasmodium falciparum
NEKVVFSAVRVLSALLS

SEQ ID NO: 3389645 - protein, 21 aa, Plasmodium falciparum
NEKWLILDGPFDIMTTEPLHS

SEQ ID NO: 3389646 - protein, 22 aa, Plasmodium falciparum
NEKYALEILTLTNKNKILSETV

SEQ ID NO: 3389647 - protein, 17 aa, Plasmodium falciparum
NEKYNLRKIIGVTKLKL

SEQ ID NO: 3389648 - protein, 27 aa, Plasmodium falciparum
NELDLSAVALLEYYSKKNNIPKDLSYI

SEQ ID NO: 3389649 - protein, 24 aa, Plasmodium falciparum
NELEDNFIIGLYGNNFRCSFNSDS

SEQ ID NO: 3389650 - protein, 33 aa, Plasmodium falciparum
NELFEEHSFVYPSIYDIYPDEWFRANKYDDWLV

SEQ ID NO: 3389651 - protein, 19 aa, Plasmodium falciparum
NELFKLMPLCKSSYNIFNH

SEQ ID NO: 3389652 - protein, 23 aa, Plasmodium falciparum
NELFKYDLICDVYNKKCSYYKEK

SEQ ID NO: 3389653 - protein, 21 aa, Plasmodium falciparum
NELHHLVNALPYIDSYDNELE

SEQ ID NO: 3389654 - protein, 18 aa, Plasmodium falciparum
NELIIIKITEFLTILEIQ

SEQ ID NO: 3389655 - protein, 24 aa, Plasmodium falciparum
NELIKYVSLFLWIQKKISKNEKKI

SEQ ID NO: 3389656 - protein, 24 aa, Plasmodium falciparum
NELKRRYACLSKPDGRYIFLGAPG

SEQ ID NO: 3389657 - protein, 32 aa, Plasmodium falciparum
NELKSHEYIFLLFKIYEIIFYNFYCYYEDSEI

SEQ ID NO: 3389658 - protein, 22 aa, Plasmodium falciparum
NELLFFQIRNGPWIPNLKLVHK

SEQ ID NO: 3389659 - protein, 17 aa, Plasmodium falciparum
NELLLKNKKMSKSTKGR

SEQ ID NO: 3389660 - protein, 21 aa, Plasmodium falciparum
NELLLPIAKLQKSFPLIEWWQ

SEQ ID NO: 3389661 - protein, 17 aa, Plasmodium falciparum
NELNKELRNAHNLSIIN

SEQ ID NO: 3389662 - protein, 27 aa, Plasmodium falciparum
NELRIKPDMRKTKLCKSYILGKCTDNN

SEQ ID NO: 3389663 - protein, 19 aa, Plasmodium falciparum
NELVIVDFFAEWCGPCKRI

SEQ ID NO: 3389664 - protein, 17 aa, Plasmodium falciparum
NELYKKEYKLKRLHKKI

SEQ ID NO: 3389665 - protein, 27 aa, Plasmodium falciparum
NELYSNVRWLYDSLIIGSTYSGYFSLF

SEQ ID NO: 3389666 - protein, 17 aa, Plasmodium falciparum
NEMIPAIFPVIQDLLNH

SEQ ID NO: 3389667 - protein, 26 aa, Plasmodium falciparum
NEMKKFICSFIKYYDKLKNDLLNEHK

SEQ ID NO: 3389668 - protein, 17 aa, Plasmodium falciparum
NEMSLVNHYKTCSVFNN

SEQ ID NO: 3389669 - protein, 24 aa, Plasmodium falciparum
NENAEIFYPLHKKFRYLNCVNSVF

SEQ ID NO: 3389670 - protein, 32 aa, Plasmodium falciparum
NENDELYKTVLYFEKKNKKILKMRRSLKRKRK

SEQ ID NO: 3389671 - protein, 22 aa, Plasmodium falciparum
NENDLIFYYRSLCPINDLYNWL

SEQ ID NO: 3389672 - protein, 24 aa, Plasmodium falciparum
NENDNMLFLLNEKSNIQEIIDSSN

SEQ ID NO: 3389673 - protein, 23 aa, Plasmodium falciparum
NENEFIKYKFQNMLRKNISLERS

SEQ ID NO: 3389674 - protein, 23 aa, Plasmodium falciparum
NENIHMLIKIIYNLFLCNYHNYK

SEQ ID NO: 3389675 - protein, 17 aa, Plasmodium falciparum
NENIHVSIYGGQKKRHV

SEQ ID NO: 3389676 - protein, 18 aa, Plasmodium falciparum
NENIPITKLLKKMDNIYL

SEQ ID NO: 3389677 - protein, 22 aa, Plasmodium falciparum
NENKYILDKLLISLKNNSDANI

SEQ ID NO: 3389678 - protein, 29 aa, Plasmodium falciparum
NENLLDEDTLLKLLSYDFLNIQKDIQEFN

SEQ ID NO: 3389679 - protein, 24 aa, Plasmodium falciparum
NENLSDELFFLKNKNYSVEKYRED

SEQ ID NO: 3389680 - protein, 23 aa, Plasmodium falciparum
NENLYLEIDKLLKKRRKGKTYKN

SEQ ID NO: 3389681 - protein, 25 aa, Plasmodium falciparum
NENNFFIKSFFESLSNFIKNIKIEI

SEQ ID NO: 3389682 - protein, 24 aa, Plasmodium falciparum
NENNSFLINVIDSFYLNHINGNDI

SEQ ID NO: 3389683 - protein, 26 aa, Plasmodium falciparum
NENQYFGHQLILNNIKAFFIAVAIID

SEQ ID NO: 3389684 - protein, 31 aa, Plasmodium falciparum
NENTLLEHILTNIYIFIEKNVKFNNFLPSTD

SEQ ID NO: 3389685 - protein, 24 aa, Plasmodium falciparum
NENYKYLRRSLSEPNIYKYNRFMG

SEQ ID NO: 3389686 - protein, 28 aa, Plasmodium falciparum
NEPKKKFLIGAKPILPTCNEELLEKLKQ

SEQ ID NO: 3389687 - protein, 20 aa, Plasmodium falciparum
NEPLKYHYGINYKNIKCMCA

SEQ ID NO: 3389688 - protein, 24 aa, Plasmodium falciparum
NEQISIIRTFIKKIKLKQEIDVIK

SEQ ID NO: 3389689 - protein, 27 aa, Plasmodium falciparum
NEQKVLTPTKYFVNDMSYVGSVGKTRQ

SEQ ID NO: 3389690 - protein, 30 aa, Plasmodium falciparum
NEQQDCHEFLLLVFDFIHNMVKVIDESVDK

SEQ ID NO: 3389691 - protein, 27 aa, Plasmodium falciparum
NEQSEQIIFNIFKQVDNSNFLEILKEV

SEQ ID NO: 3389692 - protein, 26 aa, Plasmodium falciparum
NERDIVCKLFYLIKSYFSYDINNNNH

SEQ ID NO: 3389693 - protein, 23 aa, Plasmodium falciparum
NERERSTILTTEYSNKIVNYEIS

SEQ ID NO: 3389694 - protein, 19 aa, Plasmodium falciparum
NERNYLNVPPHNYMNEPNY

SEQ ID NO: 3389695 - protein, 27 aa, Plasmodium falciparum
NESEINRYIMQAKKLIYLRDEQNKQLS

SEQ ID NO: 3389696 - protein, 29 aa, Plasmodium falciparum
NESIIQIDPTLFLLNLKDLSNEKNIFLKN

SEQ ID NO: 3389697 - protein, 25 aa, Plasmodium falciparum
NESIKKPWFFTIKKNMKPSDITELR

SEQ ID NO: 3389698 - protein, 25 aa, Plasmodium falciparum
NESITFRVRCLIKDVIDNRNEKWNK

SEQ ID NO: 3389699 - protein, 24 aa, Plasmodium falciparum
NESLYDILPLYDIQGKVWPSKMNP

SEQ ID NO: 3389700 - protein, 47 aa, Plasmodium falciparum
NESRNNYIYIYIKREYIPEYLLNIKKKIKLILLFSSNNIDNNVHNKN

SEQ ID NO: 3389701 - protein, 30 aa, Plasmodium falciparum
NETCIKELFILLIPYIRYLIQNKNYIYSKD

SEQ ID NO: 3389702 - protein, 27 aa, Plasmodium falciparum
NETDKMKIIMFFINIIRDSNICNEFVK

SEQ ID NO: 3389703 - protein, 24 aa, Plasmodium falciparum
NETEKKNIKLDYPKDFESNNKHDK

SEQ ID NO: 3389704 - protein, 26 aa, Plasmodium falciparum
NETFQIYVFKIIPNKTLLLNKKNVQD

SEQ ID NO: 3389705 - protein, 26 aa, Plasmodium falciparum
NETLRRSYMFLKRGGRDFFTRTVHNM

SEQ ID NO: 3389706 - protein, 18 aa, Plasmodium falciparum
NEVFLKQITFSDNINWYH

SEQ ID NO: 3389707 - protein, 23 aa, Plasmodium falciparum
NEVKLLLDKLPADTIKFNTDQIG

SEQ ID NO: 3389708 - protein, 17 aa, Plasmodium falciparum
NEVKYLEKFFMKDYNKN

SEQ ID NO: 3389709 - protein, 56 aa, Plasmodium falciparum
NEVLYVCFNKENGNYLLLLDNKGHLYIYKINEYKLDLILCLNFPPYEKKNPNYNIL

SEQ ID NO: 3389710 - protein, 50 aa, Plasmodium falciparum
NEVQKENFYKIIFQDLFSLLNEFIMVDDYTKRFFFSVERDVRQKCLENIK

SEQ ID NO: 3389711 - protein, 20 aa, Plasmodium falciparum
NEWGWSKSKLGANAILAISM

SEQ ID NO: 3389712 - protein, 19 aa, Plasmodium falciparum
NEWQLGPSLLVPRFGHSVL

SEQ ID NO: 3389713 - protein, 22 aa, Plasmodium falciparum
NEYDILDFFKDCGQIKKIQLYN

SEQ ID NO: 3389714 - protein, 20 aa, Plasmodium falciparum
NEYIIFLNYNFEKFMNFINP

SEQ ID NO: 3389715 - protein, 19 aa, Plasmodium falciparum
NEYIKMEKLKESQDRLFIA

SEQ ID NO: 3389716 - protein, 24 aa, Plasmodium falciparum
NEYKILEYSFIRKCIYIRNENSPK

SEQ ID NO: 3389717 - protein, 29 aa, Plasmodium falciparum
NEYKSIIKEKLFGKIIFKEYLVISDDVEY

SEQ ID NO: 3389718 - protein, 23 aa, Plasmodium falciparum
NEYKSMMNSFETLKIYEQDENNK

SEQ ID NO: 3389719 - protein, 27 aa, Plasmodium falciparum
NEYLDNYYINSLLSHSFNIYDNKSIYD

SEQ ID NO: 3389720 - protein, 21 aa, Plasmodium falciparum
NEYLKFYMDKINDVKFLKVLT

SEQ ID NO: 3389721 - protein, 32 aa, Plasmodium falciparum
NEYNIDFLYNPKLFSFTLLPHRLDKKLLELCK

SEQ ID NO: 3389722 - protein, 17 aa, Plasmodium falciparum
NEYSSFVFSLNMNTQIL

SEQ ID NO: 3389723 - protein, 17 aa, Plasmodium falciparum
NEYVYFDIYINSDIINI

SEQ ID NO: 3389724 - protein, 21 aa, Plasmodium falciparum
NEYYLCLIGNYFSLKNNKRLG

SEQ ID NO: 3389725 - protein, 18 aa, Plasmodium falciparum
NFAFKYIHVSSHPKYRNF

SEQ ID NO: 3389726 - protein, 26 aa, Plasmodium falciparum
NFASNQTPLIKHQKFYYAENSNNNYL

SEQ ID NO: 3389727 - protein, 20 aa, Plasmodium falciparum
NFCNNFSMYANMMNIQNVNG

SEQ ID NO: 3389728 - protein, 24 aa, Plasmodium falciparum
NFCNYEIFKFFTKNYYKNLNDKDL

SEQ ID NO: 3389729 - protein, 17 aa, Plasmodium falciparum
NFCYIKITFNKLGGMVL

SEQ ID NO: 3389730 - protein, 17 aa, Plasmodium falciparum
NFDEFFDIATKYLHTRY

SEQ ID NO: 3389731 - protein, 18 aa, Plasmodium falciparum
NFDLLICTDLPLYYSHIK

SEQ ID NO: 3389732 - protein, 17 aa, Plasmodium falciparum
NFDNFKDIKLDLGDKIN

SEQ ID NO: 3389733 - protein, 25 aa, Plasmodium falciparum
NFEEEIKMNLLKSKMLHISEDLLKN

SEQ ID NO: 3389734 - protein, 26 aa, Plasmodium falciparum
NFEELYNVIILPFNKIKFQQTEEPVD

SEQ ID NO: 3389735 - protein, 23 aa, Plasmodium falciparum
NFEFDSYLNKLNNLKSMLHQNES

SEQ ID NO: 3389736 - protein, 19 aa, Plasmodium falciparum
NFEKDIYIYKNKLNKLNNK

SEQ ID NO: 3389737 - protein, 18 aa, Plasmodium falciparum
NFEKIKCIVLGGPGFFKN

SEQ ID NO: 3389738 - protein, 26 aa, Plasmodium falciparum
NFEKYKYDFIIYSSDGDLDSCSSSSS

SEQ ID NO: 3389739 - protein, 18 aa, Plasmodium falciparum
NFELFENVAIIKKELYDE

SEQ ID NO: 3389740 - protein, 24 aa, Plasmodium falciparum
NFELPLKWHYAALCSITMLNDFNY

SEQ ID NO: 3389741 - protein, 20 aa, Plasmodium falciparum
NFEQYGLGFKILRKMGYEDG

SEQ ID NO: 3389742 - protein, 19 aa, Plasmodium falciparum
NFEVDISKIFFICTANSVE

SEQ ID NO: 3389743 - protein, 19 aa, Plasmodium falciparum
NFEYFNEGVLFFHNSKKTN

SEQ ID NO: 3389744 - protein, 19 aa, Plasmodium falciparum
NFFFVKYVHLKDAIKAYEN

SEQ ID NO: 3389745 - protein, 24 aa, Plasmodium falciparum
NFFIERICIIINPIIPHVTEHIWT

SEQ ID NO: 3389746 - protein, 25 aa, Plasmodium falciparum
NFFQSYILHYGLYYNDILQINHRNF

SEQ ID NO: 3389747 - protein, 18 aa, Plasmodium falciparum
NFFRLAPNRTVRLRYAFC

SEQ ID NO: 3389748 - protein, 29 aa, Plasmodium falciparum
NFHIHSNYMMLLIKLLTKIIKIYDNLHNL

SEQ ID NO: 3389749 - protein, 17 aa, Plasmodium falciparum
NFILPEVSELEKLYTTI

SEQ ID NO: 3389750 - protein, 26 aa, Plasmodium falciparum
NFINLPHILLCAPLKNSPLLLNYTIL

SEQ ID NO: 3389751 - protein, 18 aa, Plasmodium falciparum
NFITRNFFGLFKNECNAN

SEQ ID NO: 3389752 - protein, 31 aa, Plasmodium falciparum
NFKEYEHYIQYPILLLFKNTEKIKKNFLLNL

SEQ ID NO: 3389753 - protein, 28 aa, Plasmodium falciparum
NFKIFNLNSFQLLVLLRSLIYSNFTNPH

SEQ ID NO: 3389754 - protein, 24 aa, Plasmodium falciparum
NFKKKQIIGMWENFSNYEFRNNKE

SEQ ID NO: 3389755 - protein, 22 aa, Plasmodium falciparum
NFKKMYNIQMQTIPALMCGRDV

SEQ ID NO: 3389756 - protein, 45 aa, Plasmodium falciparum
NFKKRRIPDELAYKYFCHVVNGLYYLNQMGIFHRDIKMENVLVDH

SEQ ID NO: 3389757 - protein, 22 aa, Plasmodium falciparum
NFKNFQNRLISLRKICEEKLKE

SEQ ID NO: 3389758 - protein, 38 aa, Plasmodium falciparum
NFKNNLNYLIYKYFNTVLYYKNKILQNVLITRPIEPDM

SEQ ID NO: 3389759 - protein, 35 aa, Plasmodium falciparum
NFKPCYESLIILYFLYSLVRYHECDFILAHPIDQK

SEQ ID NO: 3389760 - protein, 25 aa, Plasmodium falciparum
NFKTTKSFFYFNKSSSLNMGEDMDE

SEQ ID NO: 3389761 - protein, 21 aa, Plasmodium falciparum
NFKVCIYINVLFSNNFITNPS

SEQ ID NO: 3389762 - protein, 17 aa, Plasmodium falciparum
NFLFEYIISADYNGTIF

SEQ ID NO: 3389763 - protein, 17 aa, Plasmodium falciparum
NFLLQKSSMNNNNMNNN

SEQ ID NO: 3389764 - protein, 17 aa, Plasmodium falciparum
NFLNFYIIEKLLVTLCD

SEQ ID NO: 3389765 - protein, 29 aa, Plasmodium falciparum
NFLNNIKIKFNFLDNFFLKIWENNNEVIN

SEQ ID NO: 3389766 - protein, 19 aa, Plasmodium falciparum
NFLNPKKDIIKKNDLKILL

SEQ ID NO: 3389767 - protein, 18 aa, Plasmodium falciparum
NFLRAIFNALSKTYGYLT

SEQ ID NO: 3389768 - protein, 18 aa, Plasmodium falciparum
NFLRSKIVKYFNLKNDEL

SEQ ID NO: 3389769 - protein, 25 aa, Plasmodium falciparum
NFLSKLLPNIFLKYKADTPIYDLPY

SEQ ID NO: 3389770 - protein, 18 aa, Plasmodium falciparum
NFLSYINWFIEKNELNKK

SEQ ID NO: 3389771 - protein, 17 aa, Plasmodium falciparum
NFLTDLFILKNVEHINL

SEQ ID NO: 3389772 - protein, 27 aa, Plasmodium falciparum
NFLTLKCIHLYFASHLSYPNTVGYIIE

SEQ ID NO: 3389773 - protein, 27 aa, Plasmodium falciparum
NFLVLNGIPRYRILFDIGLGFAKKHDQ

SEQ ID NO: 3389774 - protein, 19 aa, Plasmodium falciparum
NFLYQWRETNKAGQKFYDQ

SEQ ID NO: 3389775 - protein, 18 aa, Plasmodium falciparum
NFMLKFKRHIGNKIIWGR

SEQ ID NO: 3389776 - protein, 24 aa, Plasmodium falciparum
NFNFKWFPTPIINYKFKKYVLLSF

SEQ ID NO: 3389777 - protein, 17 aa, Plasmodium falciparum
NFNFVTMSNFYGVNEKK

SEQ ID NO: 3389778 - protein, 17 aa, Plasmodium falciparum
NFNIHRDGMYLKDEQNT

SEQ ID NO: 3389779 - protein, 27 aa, Plasmodium falciparum
NFNKIVEFLFDILYYCDIILSENKNKK

SEQ ID NO: 3389780 - protein, 29 aa, Plasmodium falciparum
NFNLRKELFHYKQKILFYKTYVNDMRDKL

SEQ ID NO: 3389781 - protein, 35 aa, Plasmodium falciparum
NFNNFIKNIKIAQLKLLYYAFRKLSNNLCYNYDPV

SEQ ID NO: 3389782 - protein, 23 aa, Plasmodium falciparum
NFNNNVMMLMNTSNNIPLDNNTY

SEQ ID NO: 3389783 - protein, 26 aa, Plasmodium falciparum
NFNNSKGFIINPFNENYKKNNICTYL

SEQ ID NO: 3389784 - protein, 25 aa, Plasmodium falciparum
NFNTKRWNIILSLKRDNCLLITGTP

SEQ ID NO: 3389785 - protein, 25 aa, Plasmodium falciparum
NFNVDFILKNYIRKVIFAKKKKKKV

SEQ ID NO: 3389786 - protein, 19 aa, Plasmodium falciparum
NFNYLNIIKRHNFKHIYII

SEQ ID NO: 3389787 - protein, 26 aa, Plasmodium falciparum
NFPNDIQSFFKFLNSKDVKDETKGKK

SEQ ID NO: 3389788 - protein, 23 aa, Plasmodium falciparum
NFQKNQFFSLKSKPYNVSAEFWK

SEQ ID NO: 3389789 - protein, 20 aa, Plasmodium falciparum
NFRFFPEIYNWKWIAHIEDL

SEQ ID NO: 3389790 - protein, 19 aa, Plasmodium falciparum
NFRFSIRNFSLCKKIYYNG

SEQ ID NO: 3389791 - protein, 17 aa, Plasmodium falciparum
NFRKFSTQRFGYDVAIS

SEQ ID NO: 3389792 - protein, 22 aa, Plasmodium falciparum
NFRNYIIIKCGHIYCNNCIFNN

SEQ ID NO: 3389793 - protein, 28 aa, Plasmodium falciparum
NFRSKNPFLSVFNFNSLILANTITDIQK

SEQ ID NO: 3389794 - protein, 21 aa, Plasmodium falciparum
NFSFFFLNSFIHDIKEHNKLY

SEQ ID NO: 3389795 - protein, 23 aa, Plasmodium falciparum
NFSIYLAFYNYTSAYQRILDLLS

SEQ ID NO: 3389796 - protein, 25 aa, Plasmodium falciparum
NFSKFPPHIPFMAPFPPCNKETMAQ

SEQ ID NO: 3389797 - protein, 24 aa, Plasmodium falciparum
NFSNYKICEGIIKNFLNNKSMNSD

SEQ ID NO: 3389798 - protein, 19 aa, Plasmodium falciparum
NFSVFFTLNLKNELLFKCE

SEQ ID NO: 3389799 - protein, 17 aa, Plasmodium falciparum
NFTFEDIILILQSYALC

SEQ ID NO: 3389800 - protein, 19 aa, Plasmodium falciparum
NFTFELPKDYPLGSISIIN

SEQ ID NO: 3389801 - protein, 31 aa, Plasmodium falciparum
NFTKEEKILFKKWIDILPSTNLEIQNILNHQ

SEQ ID NO: 3389802 - protein, 18 aa, Plasmodium falciparum
NFTSKIKNLFLKKNKNKN

SEQ ID NO: 3389803 - protein, 17 aa, Plasmodium falciparum
NFTSNIYRFINFKCSEH

SEQ ID NO: 3389804 - protein, 17 aa, Plasmodium falciparum
NFVGFRLSFWTCFCTYS

SEQ ID NO: 3389805 - protein, 18 aa, Plasmodium falciparum
NFVHLYPYQNSNTNNQIK

SEQ ID NO: 3389806 - protein, 18 aa, Plasmodium falciparum
NFWIGYENALYQLESQLK

SEQ ID NO: 3389807 - protein, 24 aa, Plasmodium falciparum
NFYDIEIYILLTCPENNLLELKEF

SEQ ID NO: 3389808 - protein, 20 aa, Plasmodium falciparum
NFYNPKSCVPYYDKTNNNIK

SEQ ID NO: 3389809 - protein, 18 aa, Plasmodium falciparum
NFYNQTFAAFKDIALYLG

SEQ ID NO: 3389810 - protein, 33 aa, Plasmodium falciparum
NFYSPTDLTIIYYYLKKFQLLTNKKKHLSNKIQ

SEQ ID NO: 3389811 - protein, 17 aa, Plasmodium falciparum
NFYTYSESPLEIEKYII

SEQ ID NO: 3389812 - protein, 27 aa, Plasmodium falciparum
NGAVVPYEYIWNQSIHYINAFICLPLN

SEQ ID NO: 3389813 - protein, 25 aa, Plasmodium falciparum
NGDDNNFYFIKAPHFGNSSTCGKEI

SEQ ID NO: 3389814 - protein, 25 aa, Plasmodium falciparum
NGDLKCLLAIFLYILNDAMSENTKS

SEQ ID NO: 3389815 - protein, 30 aa, Plasmodium falciparum
NGECIYHNGLKYLYKLKHLFTTPMDVETLS

SEQ ID NO: 3389816 - protein, 20 aa, Plasmodium falciparum
NGFGRIGRLVFRAAFGRKDI

SEQ ID NO: 3389817 - protein, 25 aa, Plasmodium falciparum
NGFYESFSLLLKYGVDILIKDDFDM

SEQ ID NO: 3389818 - protein, 24 aa, Plasmodium falciparum
NGGIISYIWIIGEYCEYIEEAPYL

SEQ ID NO: 3389819 - protein, 17 aa, Plasmodium falciparum
NGGKREVRILRFNKDNI

SEQ ID NO: 3389820 - protein, 35 aa, Plasmodium falciparum
NGGMDNHPFYFYPRFYLPMYPYDYPHNETVPFFND

SEQ ID NO: 3389821 - protein, 17 aa, Plasmodium falciparum
NGHKYILKQIYKEYFPY

SEQ ID NO: 3389822 - protein, 23 aa, Plasmodium falciparum
NGISFFYRNSFGYSIDAACGQLY

SEQ ID NO: 3389823 - protein, 25 aa, Plasmodium falciparum
NGKAEAWIIDIKNNETYPYIKIDKK

SEQ ID NO: 3389824 - protein, 27 aa, Plasmodium falciparum
NGKGISHIFVYILPKIFGHLIDKNIDL

SEQ ID NO: 3389825 - protein, 32 aa, Plasmodium falciparum
NGKKISPFFPVWPNIPDFFGYKMFKNIKKDFK

SEQ ID NO: 3389826 - protein, 23 aa, Plasmodium falciparum
NGKNHIVIYLGKETKPLNYKNKE

SEQ ID NO: 3389827 - protein, 23 aa, Plasmodium falciparum
NGKNTAMFLKRNLAQELSNSFLE

SEQ ID NO: 3389828 - protein, 24 aa, Plasmodium falciparum
NGKSMVMLNLKDIPLKINFCSYKN

SEQ ID NO: 3389829 - protein, 23 aa, Plasmodium falciparum
NGKVNLKVRIPKTVWHYWEAVAE

SEQ ID NO: 3389830 - protein, 30 aa, Plasmodium falciparum
NGKYNYFIHFFTWGTMFVPKYFELSRGPLC

SEQ ID NO: 3389831 - protein, 25 aa, Plasmodium falciparum
NGLDFRNTFFLNPLNKCELFNPCGG

SEQ ID NO: 3389832 - protein, 20 aa, Plasmodium falciparum
NGLDSFYYINPKQLEFILNK

SEQ ID NO: 3389833 - protein, 18 aa, Plasmodium falciparum
NGLKKFLINNNKLDILLK

SEQ ID NO: 3389834 - protein, 31 aa, Plasmodium falciparum
NGLNTCELFIYFILRNMQVPSFPSSLYILQN

SEQ ID NO: 3389835 - protein, 26 aa, Plasmodium falciparum
NGMHLSKYIHLLEENKFRCMKIIYEN

SEQ ID NO: 3389836 - protein, 17 aa, Plasmodium falciparum
NGMWWENMYNNCAKKIN

SEQ ID NO: 3389837 - protein, 23 aa, Plasmodium falciparum
NGNDFYSFKYMSNILSSSCNLSK

SEQ ID NO: 3389838 - protein, 28 aa, Plasmodium falciparum
NGNELIHFLIYFFRWNKNDKNLILFYNY

SEQ ID NO: 3389839 - protein, 21 aa, Plasmodium falciparum
NGNLRMSRMQNYAGAGISGQS

SEQ ID NO: 3389840 - protein, 26 aa, Plasmodium falciparum
NGNSFNYILICLNLNTYKIDDFINSL

SEQ ID NO: 3389841 - protein, 23 aa, Plasmodium falciparum
NGNTVIWDLKIKKSAVSFRDPHS

SEQ ID NO: 3389842 - protein, 39 aa, Plasmodium falciparum
NGNVIYKSYNNVYKLTYKHIFKYKRISSISTDEVDYVIN

SEQ ID NO: 3389843 - protein, 23 aa, Plasmodium falciparum
NGPSLPTLLPFDYEYVKFKVVNK

SEQ ID NO: 3389844 - protein, 19 aa, Plasmodium falciparum
NGPYINSKVCHLSPPRVTN

SEQ ID NO: 3389845 - protein, 24 aa, Plasmodium falciparum
NGRKKKLKFLLLTTKKIYDDHDEH

SEQ ID NO: 3389846 - protein, 21 aa, Plasmodium falciparum
NGRLNYLKKYLLLINLFNLKN

SEQ ID NO: 3389847 - protein, 18 aa, Plasmodium falciparum
NGSFFLYYIVNPNRIEIS

SEQ ID NO: 3389848 - protein, 34 aa, Plasmodium falciparum
NGSGKSNIMDCICFALGINNKYLRVKNLRNLIYH

SEQ ID NO: 3389849 - protein, 20 aa, Plasmodium falciparum
NGSLLVFVNIGYANTCVCVA

SEQ ID NO: 3389850 - protein, 27 aa, Plasmodium falciparum
NGSPSINYPIFTYPLHSPSTFYNVLNE

SEQ ID NO: 3389851 - protein, 40 aa, Plasmodium falciparum
NGSRHISLLIFPFYDVQMLKRLLIKKLNLPGGVKVNDIII

SEQ ID NO: 3389852 - protein, 24 aa, Plasmodium falciparum
NGSVILFNLSYAVPFYYIEYYKEF

SEQ ID NO: 3389853 - protein, 24 aa, Plasmodium falciparum
NGVYFLNIKFPPDYPFKPPKIIFT

SEQ ID NO: 3389854 - protein, 17 aa, Plasmodium falciparum
NGWVKKFSRILKPYIKT

SEQ ID NO: 3389855 - protein, 26 aa, Plasmodium falciparum
NGYIYSPVLFINKKFKLGELVYKIPK

SEQ ID NO: 3389856 - protein, 29 aa, Plasmodium falciparum
NGYNETTFKLFLITLLISKGHVEFYKNEN

SEQ ID NO: 3389857 - protein, 24 aa, Plasmodium falciparum
NGYSFLHLNIYKNNNTYEFCRNNS

SEQ ID NO: 3389858 - protein, 18 aa, Plasmodium falciparum
NGYYSYSQPLSPMVFNNN

SEQ ID NO: 3389859 - protein, 24 aa, Plasmodium falciparum
NHANLYIYDIYQSDVFHILHDKDN

SEQ ID NO: 3389860 - protein, 21 aa, Plasmodium falciparum
NHCGHDFYSNQKVYGIQREEE

SEQ ID NO: 3389861 - protein, 30 aa, Plasmodium falciparum
NHDDSLIPMGPLPTGVYFDSARKLWRCQWK

SEQ ID NO: 3389862 - protein, 29 aa, Plasmodium falciparum
NHDFLLGIGRYHIKNILSLDAKLSKILFN

SEQ ID NO: 3389863 - protein, 25 aa, Plasmodium falciparum
NHDIANGYIKYLLQSNIKCINGYMI

SEQ ID NO: 3389864 - protein, 23 aa, Plasmodium falciparum
NHDYVICLKNYEGIEQYVKVIGQ

SEQ ID NO: 3389865 - protein, 24 aa, Plasmodium falciparum
NHEDRLFNYIYGFYKDIEIKMKTN

SEQ ID NO: 3389866 - protein, 29 aa, Plasmodium falciparum
NHEKKRKIRFFFKLYKRNDTHKKLRPIRF

SEQ ID NO: 3389867 - protein, 25 aa, Plasmodium falciparum
NHELSKHILLSKKAKVIKLESNKSL

SEQ ID NO: 3389868 - protein, 28 aa, Plasmodium falciparum
NHFEYFNIYYNYYFFYEYLNKSSNELSF

SEQ ID NO: 3389869 - protein, 20 aa, Plasmodium falciparum
NHFINLINDLFYFIYNENTI

SEQ ID NO: 3389870 - protein, 22 aa, Plasmodium falciparum
NHFLGKFKFELFQNIVPRTSEN

SEQ ID NO: 3389871 - protein, 17 aa, Plasmodium falciparum
NHFWKNIKKNIRLDGRT

SEQ ID NO: 3389872 - protein, 25 aa, Plasmodium falciparum
NHGHNILKKIKKKILYTGKASCACK

SEQ ID NO: 3389873 - protein, 25 aa, Plasmodium falciparum
NHGYMRKFLSILRSVKKNDKFQYIM

SEQ ID NO: 3389874 - protein, 19 aa, Plasmodium falciparum
NHICYENLLFKGYFYNNHF

SEQ ID NO: 3389875 - protein, 40 aa, Plasmodium falciparum
NHILGIPNNINMDSLIQTILLASSLIINTSARAVATSNRN

SEQ ID NO: 3389876 - protein, 20 aa, Plasmodium falciparum
NHINIIYLKDYYYTESFKKN

SEQ ID NO: 3389877 - protein, 20 aa, Plasmodium falciparum
NHIQTIVTQVYSLIEKTLCD

SEQ ID NO: 3389878 - protein, 17 aa, Plasmodium falciparum
NHIYPKNQNTHINNIHI

SEQ ID NO: 3389879 - protein, 25 aa, Plasmodium falciparum
NHKIIKPRNIIKMWKIRKGDEVKVI

SEQ ID NO: 3389880 - protein, 23 aa, Plasmodium falciparum
NHKINCIFMTQKNKKYIVKKKIE

SEQ ID NO: 3389881 - protein, 24 aa, Plasmodium falciparum
NHKINSFFLYCQIQLDICGPEIWF

SEQ ID NO: 3389882 - protein, 19 aa, Plasmodium falciparum
NHKNHLLNILKRKKKQLKY

SEQ ID NO: 3389883 - protein, 27 aa, Plasmodium falciparum
NHKNISYPLYLDMKYYVNNYDLFENNF

SEQ ID NO: 3389884 - protein, 22 aa, Plasmodium falciparum
NHKYNAFLKLQKYVYEQNEKKN

SEQ ID NO: 3389885 - protein, 19 aa, Plasmodium falciparum
NHLCYLLKYDSVHGQFPCE

SEQ ID NO: 3389886 - protein, 26 aa, Plasmodium falciparum
NHLDIYTIQFLIDYIKKLNKTCIIVS

SEQ ID NO: 3389887 - protein, 17 aa, Plasmodium falciparum
NHLLLSYLASSKQIKVD

SEQ ID NO: 3389888 - protein, 29 aa, Plasmodium falciparum
NHLLNDICKTILFILDDTKNYLVQNKKSY

SEQ ID NO: 3389889 - protein, 25 aa, Plasmodium falciparum
NHLNNCINKLYTNNIYFTEDSQKRN

SEQ ID NO: 3389890 - protein, 30 aa, Plasmodium falciparum
NHMKYIPINLQLITLLIRTMEHQKKYIPLF

SEQ ID NO: 3389891 - protein, 18 aa, Plasmodium falciparum
NHMLSLIKDIRKKKEKVL

SEQ ID NO: 3389892 - protein, 18 aa, Plasmodium falciparum
NHMNVNTNILYNNPIMNN

SEQ ID NO: 3389893 - protein, 19 aa, Plasmodium falciparum
NHNEVFFKRYFSLNNKSID

SEQ ID NO: 3389894 - protein, 18 aa, Plasmodium falciparum
NHNFIIYNDREEGVNQKH

SEQ ID NO: 3389895 - protein, 25 aa, Plasmodium falciparum
NHNINLLIFIILINSIKPYKKVCLN

SEQ ID NO: 3389896 - protein, 37 aa, Plasmodium falciparum
NHNKNCSFVFKIPTCCICEFDAFYIGGGPIKRTKKKN

SEQ ID NO: 3389897 - protein, 18 aa, Plasmodium falciparum
NHPALYNNTNKPLNPSLY

SEQ ID NO: 3389898 - protein, 55 aa, Plasmodium falciparum
NHPGEEFKLLRYYLIYDHLKYIVIRLRHIHKRILIFFYNYFLNSEYFISQHKQNN

SEQ ID NO: 3389899 - protein, 25 aa, Plasmodium falciparum
NHPKDNFYSYLYDSLQGKNHIFQQP

SEQ ID NO: 3389900 - protein, 19 aa, Plasmodium falciparum
NHRCAYISNFLLNSIIKYI

SEQ ID NO: 3389901 - protein, 25 aa, Plasmodium falciparum
NHSNKLLYNKITLKKHYTYEDNYNN

SEQ ID NO: 3389902 - protein, 25 aa, Plasmodium falciparum
NHTKLFKYHDIYFAEKLIYEYLNTP

SEQ ID NO: 3389903 - protein, 26 aa, Plasmodium falciparum
NHTNIPCVLDFLKHRYLKNQIYTTAV

SEQ ID NO: 3389904 - protein, 17 aa, Plasmodium falciparum
NHVFKKFLNNEDLDIHI

SEQ ID NO: 3389905 - protein, 29 aa, Plasmodium falciparum
NHVNFNPLITFSFNLYELKKEHDFAAAYI

SEQ ID NO: 3389906 - protein, 22 aa, Plasmodium falciparum
NHWIYILYFIHFCNFKRIKYYK

SEQ ID NO: 3389907 - protein, 23 aa, Plasmodium falciparum
NHYNVFYENVKGRDKMNFKYKNF

SEQ ID NO: 3389908 - protein, 24 aa, Plasmodium falciparum
NIAIFSFINPNYPLKLYNVNCSVM

SEQ ID NO: 3389909 - protein, 17 aa, Plasmodium falciparum
NIAYINALELSSNKYHN

SEQ ID NO: 3389910 - protein, 18 aa, Plasmodium falciparum
NIAYTNKIYKYTAQLFIY

SEQ ID NO: 3389911 - protein, 30 aa, Plasmodium falciparum
NICDNWNFISSLFLLNNPFFNKSFLDNIQM

SEQ ID NO: 3389912 - protein, 20 aa, Plasmodium falciparum
NICGTICHKAFNNIKTIFNT

SEQ ID NO: 3389913 - protein, 25 aa, Plasmodium falciparum
NICKLYKVVKILKKKSMKHIKINEE

SEQ ID NO: 3389914 - protein, 25 aa, Plasmodium falciparum
NICKSLWILLSITIQSVRKKNNLKK

SEQ ID NO: 3389915 - protein, 23 aa, Plasmodium falciparum
NICLLSLIYRDLSFLNNYEIKYV

SEQ ID NO: 3389916 - protein, 18 aa, Plasmodium falciparum
NICSSQVIFTLSSVVKEL

SEQ ID NO: 3389917 - protein, 25 aa, Plasmodium falciparum
NICYINDFFLLLDSNLVYNENHILH

SEQ ID NO: 3389918 - protein, 23 aa, Plasmodium falciparum
NIDDVLQSHLIFTNISKGEIAKK

SEQ ID NO: 3389919 - protein, 30 aa, Plasmodium falciparum
NIDELFILNRSINALITWLHNLQLEKNEKK

SEQ ID NO: 3389920 - protein, 23 aa, Plasmodium falciparum
NIDELLYLFDSLINDGHIITILS

SEQ ID NO: 3389921 - protein, 34 aa, Plasmodium falciparum
NIDFIQFSFRWVNCLLLREFPINISVRLLDTYIS

SEQ ID NO: 3389922 - protein, 23 aa, Plasmodium falciparum
NIDGQIFLGYHDIKILNVELKNK

SEQ ID NO: 3389923 - protein, 28 aa, Plasmodium falciparum
NIDINDSLILLFYVCKLLLDMCSKVNMN

SEQ ID NO: 3389924 - protein, 33 aa, Plasmodium falciparum
NIDKRIRDLIKKMDIYILYYKEKKKKIIDEKIN

SEQ ID NO: 3389925 - protein, 17 aa, Plasmodium falciparum
NIDLFFSSDNSVELSDE

SEQ ID NO: 3389926 - protein, 21 aa, Plasmodium falciparum
NIDMILFLLYECCIDYNQYNK

SEQ ID NO: 3389927 - protein, 25 aa, Plasmodium falciparum
NIDNVLLDEILRVQNACRKGKKKEI

SEQ ID NO: 3389928 - protein, 19 aa, Plasmodium falciparum
NIDQYIRRFTWDDAKYPRS

SEQ ID NO: 3389929 - protein, 34 aa, Plasmodium falciparum
NIDSNDMYLYNYLMFYFYLNKDKILNKWKCSKNL

SEQ ID NO: 3389930 - protein, 24 aa, Plasmodium falciparum
NIDTQIHYLSKWLGTKFPPNVPVN

SEQ ID NO: 3389931 - protein, 17 aa, Plasmodium falciparum
NIDVNYILQNINKELLI

SEQ ID NO: 3389932 - protein, 22 aa, Plasmodium falciparum
NIDYNLIKLSFNNDNLLACGSG

SEQ ID NO: 3389933 - protein, 28 aa, Plasmodium falciparum
NIEDIDYSAFKYFRTLPPKYSDENDIRN

SEQ ID NO: 3389934 - protein, 17 aa, Plasmodium falciparum
NIEDSVPMILSDKNKKT

SEQ ID NO: 3389935 - protein, 26 aa, Plasmodium falciparum
NIEFYTEEYYLKTIRYSYKVVNIQNY

SEQ ID NO: 3389936 - protein, 26 aa, Plasmodium falciparum
NIEGQFIYLIKYLDYKHFFLNTKQNA

SEQ ID NO: 3389937 - protein, 26 aa, Plasmodium falciparum
NIEIFKYLYPFYFYYIMVFEKQEKDT

SEQ ID NO: 3389938 - protein, 34 aa, Plasmodium falciparum
NIEILSVLCYNFLNIKKFLYDLSINKITNIYKIF

SEQ ID NO: 3389939 - protein, 29 aa, Plasmodium falciparum
NIEKDLYEKLAKLLIKKKIRQRDDLHFDG

SEQ ID NO: 3389940 - protein, 24 aa, Plasmodium falciparum
NIEKLYQRLILFDKLKAIEIIKNA

SEQ ID NO: 3389941 - protein, 26 aa, Plasmodium falciparum
NIELNKLHRDLHNLLFTSPKNNNINN

SEQ ID NO: 3389942 - protein, 53 aa, Plasmodium falciparum
NIERQVLKEIIIQASLKHINILELIAYFEDKTRLFLILELANGGSVRNKMKQK

SEQ ID NO: 3389943 - protein, 21 aa, Plasmodium falciparum
NIESNLLIKFDFGTTKEEITP

SEQ ID NO: 3389944 - protein, 23 aa, Plasmodium falciparum
NIETSPFINYLSNDNIMTVGNTN

SEQ ID NO: 3389945 - protein, 25 aa, Plasmodium falciparum
NIEYNYITIFNYFNYLMNNRKHYDI

SEQ ID NO: 3389946 - protein, 22 aa, Plasmodium falciparum
NIEYWKQLWRVIEKSHVLFYIL

SEQ ID NO: 3389947 - protein, 28 aa, Plasmodium falciparum
NIFDTIKYIILFIELKIIEQFPLKKYMN

SEQ ID NO: 3389948 - protein, 28 aa, Plasmodium falciparum
NIFEFKLFIKACRLTWRKSIKNLHAEYT

SEQ ID NO: 3389949 - protein, 33 aa, Plasmodium falciparum
NIFFQHFLCLYIKQQFYIFNILSYHLMNLDLRF

SEQ ID NO: 3389950 - protein, 19 aa, Plasmodium falciparum
NIFFQNMNLYSLIKNIYLT

SEQ ID NO: 3389951 - protein, 21 aa, Plasmodium falciparum
NIFIKNLWNKLSKGGIIIIVE

SEQ ID NO: 3389952 - protein, 18 aa, Plasmodium falciparum
NIFILLNEKILLKEKNKE

SEQ ID NO: 3389953 - protein, 17 aa, Plasmodium falciparum
NIFKNKFNNLSTRFIKY

SEQ ID NO: 3389954 - protein, 38 aa, Plasmodium falciparum
NIFKNVNMYFFNFKNVIKYFGLLKLYNYHFYVNNKCSS

SEQ ID NO: 3389955 - protein, 23 aa, Plasmodium falciparum
NIFNDTFFIFNENSDLYTNEEYK

SEQ ID NO: 3389956 - protein, 18 aa, Plasmodium falciparum
NIFNICILPYMFGEISVQ

SEQ ID NO: 3389957 - protein, 17 aa, Plasmodium falciparum
NIFPVKEYNNFVNYSEA

SEQ ID NO: 3389958 - protein, 20 aa, Plasmodium falciparum
NIFQGINCSILAYGQTNSGK

SEQ ID NO: 3389959 - protein, 23 aa, Plasmodium falciparum
NIFQTVFYNIYMYNGLNTCELFI

SEQ ID NO: 3389960 - protein, 18 aa, Plasmodium falciparum
NIFRKDEKFFLVTKDNSH

SEQ ID NO: 3389961 - protein, 37 aa, Plasmodium falciparum
NIFSVVHLYMRKKKLLFFYFYQDLKNPNYLLNKRKEQ

SEQ ID NO: 3389962 - protein, 30 aa, Plasmodium falciparum
NIFTIRHKNHFYKLKFNNNFVIKRNKVFNK

SEQ ID NO: 3389963 - protein, 17 aa, Plasmodium falciparum
NIFVIGKGDFNQILLPQ

SEQ ID NO: 3389964 - protein, 18 aa, Plasmodium falciparum
NIFYKTKWRNIHNSSIVR

SEQ ID NO: 3389965 - protein, 26 aa, Plasmodium falciparum
NIGDINNVVLLKTSLNYKGIINADKK

SEQ ID NO: 3389966 - protein, 27 aa, Plasmodium falciparum
NIGGYNFPYMCTPPPMYNQYYMYNGNN

SEQ ID NO: 3389967 - protein, 19 aa, Plasmodium falciparum
NIGKDKKLEKFKSFIIEDS

SEQ ID NO: 3389968 - protein, 32 aa, Plasmodium falciparum
NIGKIKLFIEIIYNIKFPSLLYTNINNFFIEP

SEQ ID NO: 3389969 - protein, 29 aa, Plasmodium falciparum
NIGSCIYCSKINFRIYKPSSQNDYSNERN

SEQ ID NO: 3389970 - protein, 27 aa, Plasmodium falciparum
NIHIENNLDILLYHNNKILSEYESIHH

SEQ ID NO: 3389971 - protein, 18 aa, Plasmodium falciparum
NIHKDFIFDYYFKGKYYN

SEQ ID NO: 3389972 - protein, 19 aa, Plasmodium falciparum
NIHNYVFYNLLTSIIQLNE

SEQ ID NO: 3389973 - protein, 27 aa, Plasmodium falciparum
NIHNYYPSFLFLSLIVEYKYIKDEETY

SEQ ID NO: 3389974 - protein, 26 aa, Plasmodium falciparum
NIHTHKDSFLLLRPQENGITQHIKGV

SEQ ID NO: 3389975 - protein, 21 aa, Plasmodium falciparum
NIHTLPFNFSINDMNIYKQNL

SEQ ID NO: 3389976 - protein, 21 aa, Plasmodium falciparum
NIHYINNYLTSIFDSGKRKES

SEQ ID NO: 3389977 - protein, 21 aa, Plasmodium falciparum
NIHYSFLYLFGGDLTNKGSPT

SEQ ID NO: 3389978 - protein, 18 aa, Plasmodium falciparum
NIICPFVRDYKSPLYLAC

SEQ ID NO: 3389979 - protein, 24 aa, Plasmodium falciparum
NIIDKPIHIFKNIKIIPPDFELIE

SEQ ID NO: 3389980 - protein, 18 aa, Plasmodium falciparum
NIIDLSSKLLLHNQWPEL

SEQ ID NO: 3389981 - protein, 31 aa, Plasmodium falciparum
NIIDMNCLWSDLYISRPFLKVLYEQKFSNPT

SEQ ID NO: 3389982 - protein, 20 aa, Plasmodium falciparum
NIIEDILIPPKNDYYINIEM

SEQ ID NO: 3389983 - protein, 30 aa, Plasmodium falciparum
NIIERECLILFNLYHDGLMLRSLSKCKQIY

SEQ ID NO: 3389984 - protein, 17 aa, Plasmodium falciparum
NIIFFDVKRKRYCLWIC

SEQ ID NO: 3389985 - protein, 25 aa, Plasmodium falciparum
NIIINNKYLFLLNNFIDKNKDKTYL

SEQ ID NO: 3389986 - protein, 20 aa, Plasmodium falciparum
NIIIQLIYRNKECNKFLYNN

SEQ ID NO: 3389987 - protein, 22 aa, Plasmodium falciparum
NIIKENKIIIPKGSYLYELIYP

SEQ ID NO: 3389988 - protein, 17 aa, Plasmodium falciparum
NIIKILKQANMQSKVLV

SEQ ID NO: 3389989 - protein, 41 aa, Plasmodium falciparum
NIIKNESLFFYLIYNNMKYIHALPFKIFWKYQNVEEFYKNK

SEQ ID NO: 3389990 - protein, 20 aa, Plasmodium falciparum
NIIKPDGYVYLLFPEENQLN

SEQ ID NO: 3389991 - protein, 28 aa, Plasmodium falciparum
NIIKRSNHIFVYLKRFLKNRDQKMNFII

SEQ ID NO: 3389992 - protein, 18 aa, Plasmodium falciparum
NIIKSCRNYDLLYSEFLM

SEQ ID NO: 3389993 - protein, 23 aa, Plasmodium falciparum
NIILHNLLQCRTNLSKLNNINDP

SEQ ID NO: 3389994 - protein, 21 aa, Plasmodium falciparum
NIILLCKYNDKLILCIISLIY

SEQ ID NO: 3389995 - protein, 17 aa, Plasmodium falciparum
NIINALRKIRTPCYMKL

SEQ ID NO: 3389996 - protein, 26 aa, Plasmodium falciparum
NIINHRNAFLSILKLLNQSNPLNNDN

SEQ ID NO: 3389997 - protein, 19 aa, Plasmodium falciparum
NIINILITSDYLLTYSTKE

SEQ ID NO: 3389998 - protein, 21 aa, Plasmodium falciparum
NIINIMKNILLPQLKNLTILN

SEQ ID NO: 3389999 - protein, 31 aa, Plasmodium falciparum
NIINKISIVNFYEFLYLYDEFPVCQTHKKKL

SEQ ID NO: 3390000 - protein, 46 aa, Plasmodium falciparum
NIINTIPHTLNNYYNFHILLNILRRKQLYHNSFNQLISKMTKNYNI

SEQ ID NO: 3390001 - protein, 29 aa, Plasmodium falciparum
NIIPSIIIFDEIDMLFQNNAYRNTMMNIF

SEQ ID NO: 3390002 - protein, 28 aa, Plasmodium falciparum
NIIQFQAGCIYLLFLLYFSQHVEENHYA

SEQ ID NO: 3390003 - protein, 30 aa, Plasmodium falciparum
NIITCILKLISISHIFTRHILKFNFDKNEQ

SEQ ID NO: 3390004 - protein, 18 aa, Plasmodium falciparum
NIITKMKSIFPHHNYHHK

SEQ ID NO: 3390005 - protein, 26 aa, Plasmodium falciparum
NIKDGLFHGFGILIYSQHEKYEGDFV

SEQ ID NO: 3390006 - protein, 20 aa, Plasmodium falciparum
NIKDLRLIYFYKHNIKMKKE

SEQ ID NO: 3390007 - protein, 48 aa, Plasmodium falciparum
NIKFDEYINVIKKWKSFYTSGQKYYLFRRKVLLIFQSDLKDIQKSQID

SEQ ID NO: 3390008 - protein, 20 aa, Plasmodium falciparum
NIKIEKLEHILLKYTTGINN

SEQ ID NO: 3390009 - protein, 18 aa, Plasmodium falciparum
NIKIKRQKIKQTDIYFLC

SEQ ID NO: 3390010 - protein, 37 aa, Plasmodium falciparum
NIKISNILIYLNIISTDIMFIHTNISYINEYITKSTI

SEQ ID NO: 3390011 - protein, 31 aa, Plasmodium falciparum
NIKIYNKIIIKLFLKNRKYYEQIKRIALGYI

SEQ ID NO: 3390012 - protein, 24 aa, Plasmodium falciparum
NIKKHVINKIWSILTGKQNLNTAL

SEQ ID NO: 3390013 - protein, 23 aa, Plasmodium falciparum
NIKKINLYNIYNNKNDDKDNILD

SEQ ID NO: 3390014 - protein, 23 aa, Plasmodium falciparum
NIKKIYLFKETEKDIFYQCLYDD

SEQ ID NO: 3390015 - protein, 26 aa, Plasmodium falciparum
NIKKKLMFFKAFNNKIPYIMIKAQLE

SEQ ID NO: 3390016 - protein, 18 aa, Plasmodium falciparum
NIKKLWKEKMTTLYNYDN

SEQ ID NO: 3390017 - protein, 18 aa, Plasmodium falciparum
NIKKTYATSLLFLSEWKG

SEQ ID NO: 3390018 - protein, 24 aa, Plasmodium falciparum
NIKLNILFNFLNECLNIKKIIYNF

SEQ ID NO: 3390019 - protein, 24 aa, Plasmodium falciparum
NIKNCNFIMGRPPPLPLRNSYNVF

SEQ ID NO: 3390020 - protein, 28 aa, Plasmodium falciparum
NIKNGILDNVYYYIYESYDQRDYDILEN

SEQ ID NO: 3390021 - protein, 26 aa, Plasmodium falciparum
NIKNGYSYCLICCSQKIRIGSIINNT

SEQ ID NO: 3390022 - protein, 28 aa, Plasmodium falciparum
NIKNKHLYNFKFLKYFIIEESESLCNVF

SEQ ID NO: 3390023 - protein, 26 aa, Plasmodium falciparum
NIKNNILYIKWVYNRLAFVTTSNNLL

SEQ ID NO: 3390024 - protein, 27 aa, Plasmodium falciparum
NIKPIHFEYAPFKFTFLDTPGHKVFQI

SEQ ID NO: 3390025 - protein, 28 aa, Plasmodium falciparum
NIKQFVCVFKIQLRYFDIARISMYSEFK

SEQ ID NO: 3390026 - protein, 22 aa, Plasmodium falciparum
NIKRIIFYSLKKYDGDILRYLT

SEQ ID NO: 3390027 - protein, 25 aa, Plasmodium falciparum
NIKRQLFHLEYSKIHSRLFKSLHEW

SEQ ID NO: 3390028 - protein, 23 aa, Plasmodium falciparum
NIKSFLNYCKAKYLNPLLINKNE

SEQ ID NO: 3390029 - protein, 28 aa, Plasmodium falciparum
NIKSIDPQYKILLKKKNKLNKKWEQIND

SEQ ID NO: 3390030 - protein, 25 aa, Plasmodium falciparum
NIKSIIYPLMIEAFFILKIDLSNNS

SEQ ID NO: 3390031 - protein, 31 aa, Plasmodium falciparum
NIKSNKYRRFYRFLLYDGKSFIYAYEQEYNE

SEQ ID NO: 3390032 - protein, 28 aa, Plasmodium falciparum
NIKTNLDALLYIGKKIRPRLLAKGFFSS

SEQ ID NO: 3390033 - protein, 31 aa, Plasmodium falciparum
NIKYETRNLPLGDIIWICRRSVYNKNSSSNK

SEQ ID NO: 3390034 - protein, 23 aa, Plasmodium falciparum
NIKYKINPPQPPLGKPPTLSEGY

SEQ ID NO: 3390035 - protein, 17 aa, Plasmodium falciparum
NIKYSLFVKKDTCIISS

SEQ ID NO: 3390036 - protein, 27 aa, Plasmodium falciparum
NILDHFNMNFLERLNYYFSKLYYQNNN

SEQ ID NO: 3390037 - protein, 28 aa, Plasmodium falciparum
NILEDVNLLIQKYRTISLKLLNITNKKE

SEQ ID NO: 3390038 - protein, 18 aa, Plasmodium falciparum
NILENYEHIMNSLNLDNT

SEQ ID NO: 3390039 - protein, 28 aa, Plasmodium falciparum
NILHPDMIVFLYFLLICNSLSNDIKENT

SEQ ID NO: 3390040 - protein, 19 aa, Plasmodium falciparum
NILIDFFSKCLFSNTLSSL

SEQ ID NO: 3390041 - protein, 24 aa, Plasmodium falciparum
NILKNLFLKDKKKNYFLICTLNNK

SEQ ID NO: 3390042 - protein, 28 aa, Plasmodium falciparum
NILKNYANILIFYLEHNKMYCCCCNRKL

SEQ ID NO: 3390043 - protein, 18 aa, Plasmodium falciparum
NILKRYYIDFSDLYPSGL

SEQ ID NO: 3390044 - protein, 17 aa, Plasmodium falciparum
NILLQLQHDNILSIKEV

SEQ ID NO: 3390045 - protein, 32 aa, Plasmodium falciparum
NILNEVLISLPFSYAYKLLDYIKTYLISFHFF

SEQ ID NO: 3390046 - protein, 17 aa, Plasmodium falciparum
NILNKYLTPDKIKYIKH

SEQ ID NO: 3390047 - protein, 18 aa, Plasmodium falciparum
NILNNRILRNEKIAFRQP

SEQ ID NO: 3390048 - protein, 20 aa, Plasmodium falciparum
NILPLSELFHQSNINELKLP

SEQ ID NO: 3390049 - protein, 28 aa, Plasmodium falciparum
NILQNLFNIYVCSYLMKKNNYNISHIEK

SEQ ID NO: 3390050 - protein, 26 aa, Plasmodium falciparum
NILSKTNFFPRISLITTKYITFFNHF

SEQ ID NO: 3390051 - protein, 18 aa, Plasmodium falciparum
NILSRFKINYAPNEKFLN

SEQ ID NO: 3390052 - protein, 18 aa, Plasmodium falciparum
NIMDILNNKMNITSLENV

SEQ ID NO: 3390053 - protein, 18 aa, Plasmodium falciparum
NIMEYLMSDNYIHINSPQ

SEQ ID NO: 3390054 - protein, 23 aa, Plasmodium falciparum
NIMKKKCDLFFKSNFNNIHVQSP

SEQ ID NO: 3390055 - protein, 27 aa, Plasmodium falciparum
NIMNNYHYFTSTLCPQQTYLSKHSAQE

SEQ ID NO: 3390056 - protein, 20 aa, Plasmodium falciparum
NIMPHVSYKINENYYLQMNN

SEQ ID NO: 3390057 - protein, 19 aa, Plasmodium falciparum
NIMTKDYFLKHAKSILCNM

SEQ ID NO: 3390058 - protein, 26 aa, Plasmodium falciparum
NINEKLVYYFTKKLLLNMPREIYVDE

SEQ ID NO: 3390059 - protein, 20 aa, Plasmodium falciparum
NINELNIHKMLLLGLQNIHI

SEQ ID NO: 3390060 - protein, 29 aa, Plasmodium falciparum
NINEPKIYNPLFITNDFRLKICYSNNFMD

SEQ ID NO: 3390061 - protein, 24 aa, Plasmodium falciparum
NINEQYLNNFLTKEGDNYIDEDLL

SEQ ID NO: 3390062 - protein, 25 aa, Plasmodium falciparum
NINEWKIKYRYLTSSFRKLDKEINK

SEQ ID NO: 3390063 - protein, 22 aa, Plasmodium falciparum
NINHEYYKKLTPLKVKNENDED

SEQ ID NO: 3390064 - protein, 24 aa, Plasmodium falciparum
NINHKNIIIINKKVSDKDNIVLKS

SEQ ID NO: 3390065 - protein, 18 aa, Plasmodium falciparum
NINIFINNNIYELKEING

SEQ ID NO: 3390066 - protein, 21 aa, Plasmodium falciparum
NINIHKYDDILYYMNKAICNS

SEQ ID NO: 3390067 - protein, 22 aa, Plasmodium falciparum
NINILFKYECILQKFGEYNEKN

SEQ ID NO: 3390068 - protein, 33 aa, Plasmodium falciparum
NINKAKPTFWNKPKGKMFFLTKKEKSISQAKEI

SEQ ID NO: 3390069 - protein, 27 aa, Plasmodium falciparum
NINKHLTISFILYKVVNALLNSVLNKV

SEQ ID NO: 3390070 - protein, 25 aa, Plasmodium falciparum
NINKKILCILPGKFAWSVDINVMVL

SEQ ID NO: 3390071 - protein, 23 aa, Plasmodium falciparum
NINKKINFPISSTVGYPIYSNKN

SEQ ID NO: 3390072 - protein, 23 aa, Plasmodium falciparum
NINKKNIYIIKQNSFMLSKNVQM

SEQ ID NO: 3390073 - protein, 19 aa, Plasmodium falciparum
NINKLLVLPLYPQSAECTV

SEQ ID NO: 3390074 - protein, 25 aa, Plasmodium falciparum
NINKNIIVFFENLDIYMSVNGLLIC

SEQ ID NO: 3390075 - protein, 24 aa, Plasmodium falciparum
NINKQFYWNIYNPILNERVFHNLK

SEQ ID NO: 3390076 - protein, 20 aa, Plasmodium falciparum
NINLFKCFFKYYYRIQNHEY

SEQ ID NO: 3390077 - protein, 18 aa, Plasmodium falciparum
NINLMEIFQRLNLFFIKN

SEQ ID NO: 3390078 - protein, 31 aa, Plasmodium falciparum
NINLNKVPYDLVYSFLLDGELYLGYDISVFI

SEQ ID NO: 3390079 - protein, 20 aa, Plasmodium falciparum
NINNILFKKSLYNNNILFKK

SEQ ID NO: 3390080 - protein, 19 aa, Plasmodium falciparum
NINNLIHNMKLLNTEYESP

SEQ ID NO: 3390081 - protein, 17 aa, Plasmodium falciparum
NINNMWFLKIKNNSDFN

SEQ ID NO: 3390082 - protein, 24 aa, Plasmodium falciparum
NINNNNVPLCIPQLDNYNKTKNNF

SEQ ID NO: 3390083 - protein, 25 aa, Plasmodium falciparum
NINNSKYFLSDKGYVLTPKRCLARH

SEQ ID NO: 3390084 - protein, 25 aa, Plasmodium falciparum
NINQPNLINYQYPMNHVQHINHPDN

SEQ ID NO: 3390085 - protein, 25 aa, Plasmodium falciparum
NINRRALAAYNFLKSLNIKNENILL

SEQ ID NO: 3390086 - protein, 24 aa, Plasmodium falciparum
NINRSTIYDFPSSGPVNNSLFYIN

SEQ ID NO: 3390087 - protein, 25 aa, Plasmodium falciparum
NINSEWSWSWGRLPHLKTHDAVSDN

SEQ ID NO: 3390088 - protein, 22 aa, Plasmodium falciparum
NINTAFITVLNNYLIQWNEIIN

SEQ ID NO: 3390089 - protein, 26 aa, Plasmodium falciparum
NINVKNLIIVPLSTLPNWISEFNRWC

SEQ ID NO: 3390090 - protein, 20 aa, Plasmodium falciparum
NINVNKIKTTNLINLKVEDN

SEQ ID NO: 3390091 - protein, 23 aa, Plasmodium falciparum
NINVQKWIHGIHSNKFNDTHNNN

SEQ ID NO: 3390092 - protein, 17 aa, Plasmodium falciparum
NINWDPLFFEKKYQHYK

SEQ ID NO: 3390093 - protein, 17 aa, Plasmodium falciparum
NINYFIFYKYIINKLIN

SEQ ID NO: 3390094 - protein, 18 aa, Plasmodium falciparum
NINYSFPADIWSLGIILY

SEQ ID NO: 3390095 - protein, 18 aa, Plasmodium falciparum
NINYYLFKNDKIKKKNIY

SEQ ID NO: 3390096 - protein, 27 aa, Plasmodium falciparum
NIPDANMNFIYLSLQKKLKQKKNKEIK

SEQ ID NO: 3390097 - protein, 20 aa, Plasmodium falciparum
NIPILFIHSINDCLCWYEGT

SEQ ID NO: 3390098 - protein, 31 aa, Plasmodium falciparum
NIPQEFLCKLCNYLLLESYIIVCNNNCGYSV

SEQ ID NO: 3390099 - protein, 17 aa, Plasmodium falciparum
NIPRKSLSKKHSIKYDD

SEQ ID NO: 3390100 - protein, 33 aa, Plasmodium falciparum
NIPYKISSPLIFKLISHRPLFKCAVLMFQKEFA

SEQ ID NO: 3390101 - protein, 33 aa, Plasmodium falciparum
NIQGVIAYSRFHKLDFRTLIHKFVKEKKFHLEK

SEQ ID NO: 3390102 - protein, 18 aa, Plasmodium falciparum
NIQIEVRVKGEIGCVIYL

SEQ ID NO: 3390103 - protein, 24 aa, Plasmodium falciparum
NIQIPFHILAIYNPILEYSKNVEK

SEQ ID NO: 3390104 - protein, 17 aa, Plasmodium falciparum
NIQLRGNILLYFSCDKN

SEQ ID NO: 3390105 - protein, 28 aa, Plasmodium falciparum
NIQNKFLKNLDLYCILKFIITNNIEIYN

SEQ ID NO: 3390106 - protein, 20 aa, Plasmodium falciparum
NIQTLLQRNLLFTPVSAYKN

SEQ ID NO: 3390107 - protein, 24 aa, Plasmodium falciparum
NIQYVSLPIVLLNKHIYAQAQTGT

SEQ ID NO: 3390108 - protein, 27 aa, Plasmodium falciparum
NIRAKQFIYNPYFKKELKGPYIKKMYE

SEQ ID NO: 3390109 - protein, 18 aa, Plasmodium falciparum
NIRERIITSIAPAIWGHK

SEQ ID NO: 3390110 - protein, 29 aa, Plasmodium falciparum
NIRNIKKYGLYKILKYKYNLPEKEISPLC

SEQ ID NO: 3390111 - protein, 25 aa, Plasmodium falciparum
NIRNKHFFFIIGMGPPENLQLKASD

SEQ ID NO: 3390112 - protein, 24 aa, Plasmodium falciparum
NIRNYLTHEGYPPQYYDYNSNLYS

SEQ ID NO: 3390113 - protein, 23 aa, Plasmodium falciparum
NIRTDLFCWAYITSLDREKQKGL

SEQ ID NO: 3390114 - protein, 19 aa, Plasmodium falciparum
NISDLFPFHNFFDNNSYSS

SEQ ID NO: 3390115 - protein, 17 aa, Plasmodium falciparum
NISHIPSTLNKDSFCSF

SEQ ID NO: 3390116 - protein, 19 aa, Plasmodium falciparum
NISIFLIPYSEHSNLDELK

SEQ ID NO: 3390117 - protein, 18 aa, Plasmodium falciparum
NISKAMDYLKNKSPYKLN

SEQ ID NO: 3390118 - protein, 25 aa, Plasmodium falciparum
NISKKTFLHTLFKSFIKPYNEKNTA

SEQ ID NO: 3390119 - protein, 23 aa, Plasmodium falciparum
NISNFYDYNFDLYRGNVSPNIMD

SEQ ID NO: 3390120 - protein, 18 aa, Plasmodium falciparum
NISQYFNKTFNISTPVKN

SEQ ID NO: 3390121 - protein, 24 aa, Plasmodium falciparum
NISRRLSIYEKKNIDFEKRKHGTH

SEQ ID NO: 3390122 - protein, 36 aa, Plasmodium falciparum
NISSIFLNNNYCIIKLSYITNIKYIEINTIFYEYNS

SEQ ID NO: 3390123 - protein, 26 aa, Plasmodium falciparum
NISSYIPLIFIHIIDRFRLQSNDNNH

SEQ ID NO: 3390124 - protein, 23 aa, Plasmodium falciparum
NISSYMDVFWKKIEKLVWEEKKR

SEQ ID NO: 3390125 - protein, 27 aa, Plasmodium falciparum
NISTKVYFYTWFYYFENMILKLDNFLD

SEQ ID NO: 3390126 - protein, 24 aa, Plasmodium falciparum
NISTLYIIFKKYMNWAYEKKRNFL

SEQ ID NO: 3390127 - protein, 25 aa, Plasmodium falciparum
NITITCILIKLISNVLKEFPILNSK

SEQ ID NO: 3390128 - protein, 35 aa, Plasmodium falciparum
NITLNKTYVKINFFLKKYILQYEEFKNSNILFCFG

SEQ ID NO: 3390129 - protein, 21 aa, Plasmodium falciparum
NITMFPMYKNEVEKNFIQVNE

SEQ ID NO: 3390130 - protein, 27 aa, Plasmodium falciparum
NITNMVSFLGYGNIKRKYVTNKCIINE

SEQ ID NO: 3390131 - protein, 21 aa, Plasmodium falciparum
NITTLFEKLASRIYSRFKEVL

SEQ ID NO: 3390132 - protein, 39 aa, Plasmodium falciparum
NIVEENILFCFSIDKDKNRLLVCIKQNDDNFFVIPNCIF

SEQ ID NO: 3390133 - protein, 25 aa, Plasmodium falciparum
NIVHKTFLISLLNLINYKILIDLHN

SEQ ID NO: 3390134 - protein, 32 aa, Plasmodium falciparum
NIVKYHGKFMYYDHMCLIFEPLGPSLYEIITR

SEQ ID NO: 3390135 - protein, 18 aa, Plasmodium falciparum
NIVLFSDAIKHICKLIRI

SEQ ID NO: 3390136 - protein, 25 aa, Plasmodium falciparum
NIVLLTGILILPYNDKIFNNLEFEG

SEQ ID NO: 3390137 - protein, 20 aa, Plasmodium falciparum
NIVNMLNLKNMKSINDLSVL

SEQ ID NO: 3390138 - protein, 33 aa, Plasmodium falciparum
NIVRYIDRFLNKANQKLYILMEFCDAGDLSRNI

SEQ ID NO: 3390139 - protein, 18 aa, Plasmodium falciparum
NIVSKYKRKIKLYSSKNE

SEQ ID NO: 3390140 - protein, 18 aa, Plasmodium falciparum
NIWVKNIHNLSHGYYINN

SEQ ID NO: 3390141 - protein, 17 aa, Plasmodium falciparum
NIYAIDYHQYEDTYDMV

SEQ ID NO: 3390142 - protein, 29 aa, Plasmodium falciparum
NIYDLKLFLSFLYFTYHTSSIHEYINFLF

SEQ ID NO: 3390143 - protein, 18 aa, Plasmodium falciparum
NIYDLLKSIDSYLIFEEI

SEQ ID NO: 3390144 - protein, 18 aa, Plasmodium falciparum
NIYELIILYTQKGLYKNY

SEQ ID NO: 3390145 - protein, 20 aa, Plasmodium falciparum
NIYFKGFNERNKNYLIVNEK

SEQ ID NO: 3390146 - protein, 20 aa, Plasmodium falciparum
NIYFPNCNIFNNFNKQENDI

SEQ ID NO: 3390147 - protein, 19 aa, Plasmodium falciparum
NIYGGRNYAFVCRYVIFCN

SEQ ID NO: 3390148 - protein, 20 aa, Plasmodium falciparum
NIYHELFNKIKSEEYKGNVI

SEQ ID NO: 3390149 - protein, 18 aa, Plasmodium falciparum
NIYHHKKCYDLVLDELLK

SEQ ID NO: 3390150 - protein, 18 aa, Plasmodium falciparum
NIYIKDVSVSPLINNHPN

SEQ ID NO: 3390151 - protein, 26 aa, Plasmodium falciparum
NIYKRIYFLVHLNKQIFYIDIICNFS

SEQ ID NO: 3390152 - protein, 25 aa, Plasmodium falciparum
NIYKTFNPVLLNKEKYRFFGNVNIG

SEQ ID NO: 3390153 - protein, 18 aa, Plasmodium falciparum
NIYLFSLNGFIELVLEGH

SEQ ID NO: 3390154 - protein, 20 aa, Plasmodium falciparum
NIYLNNICLGFKLASKYGPI

SEQ ID NO: 3390155 - protein, 18 aa, Plasmodium falciparum
NIYNKIMSTTLYNNFDII

SEQ ID NO: 3390156 - protein, 22 aa, Plasmodium falciparum
NIYNLFIHYLSIYINDSNKIKF

SEQ ID NO: 3390157 - protein, 24 aa, Plasmodium falciparum
NIYNPLKWHLCISDFGCSAMEYAT

SEQ ID NO: 3390158 - protein, 19 aa, Plasmodium falciparum
NIYNYHFSPYYYKKKNHFV

SEQ ID NO: 3390159 - protein, 18 aa, Plasmodium falciparum
NIYPFYKNTSINNCNNKK

SEQ ID NO: 3390160 - protein, 33 aa, Plasmodium falciparum
NIYPKKSCPFGFICKYKHFFNKVKKHKMKRRTV

SEQ ID NO: 3390161 - protein, 19 aa, Plasmodium falciparum
NIYSLLPYEYKNFLQRIRT

SEQ ID NO: 3390162 - protein, 24 aa, Plasmodium falciparum
NKAGYYNYYVYNKGFNFYEETINN

SEQ ID NO: 3390163 - protein, 30 aa, Plasmodium falciparum
NKAIIKISNVNPYYVYNRAHTMKNPSLYID

SEQ ID NO: 3390164 - protein, 22 aa, Plasmodium falciparum
NKCDSLLNHDMNVSKLNYNSNN

SEQ ID NO: 3390165 - protein, 21 aa, Plasmodium falciparum
NKCFFLIDLINSPNTGWFFNR

SEQ ID NO: 3390166 - protein, 24 aa, Plasmodium falciparum
NKCKYACEIIYYKRLEQIKSSSHN

SEQ ID NO: 3390167 - protein, 23 aa, Plasmodium falciparum
NKDENYMFLKNQGPINNLNNNVL

SEQ ID NO: 3390168 - protein, 24 aa, Plasmodium falciparum
NKDGLLLRTYSWTVKKAVGIIVLL

SEQ ID NO: 3390169 - protein, 47 aa, Plasmodium falciparum
NKDHQFNYYKWYLYHINYPNHLDFKKAYFFIFKDDIYIYGARNNQYI

SEQ ID NO: 3390170 - protein, 18 aa, Plasmodium falciparum
NKDIFFIGEIMNIEGNVI

SEQ ID NO: 3390171 - protein, 18 aa, Plasmodium falciparum
NKDKNLIRRNILNVVDTS

SEQ ID NO: 3390172 - protein, 24 aa, Plasmodium falciparum
NKDKSFKNLLSFYIHPMYNNINYN

SEQ ID NO: 3390173 - protein, 24 aa, Plasmodium falciparum
NKDLLITRILIHPEWRNNNHNYNF

SEQ ID NO: 3390174 - protein, 43 aa, Plasmodium falciparum
NKDNDNIIIIKFNILKLFKLGSCYLYIINRNLKEIQMLKNQIL

SEQ ID NO: 3390175 - protein, 26 aa, Plasmodium falciparum
NKDNIYKYLNVLSINKLIKGETYLEK

SEQ ID NO: 3390176 - protein, 21 aa, Plasmodium falciparum
NKDSLLKIIDFGLSKNLGTGE

SEQ ID NO: 3390177 - protein, 19 aa, Plasmodium falciparum
NKEEKNMVYFPSIDNIKKE

SEQ ID NO: 3390178 - protein, 32 aa, Plasmodium falciparum
NKEEQIKNAYLPFIYHMLNIPCHDTNVNLSFL

SEQ ID NO: 3390179 - protein, 23 aa, Plasmodium falciparum
NKEIEVFPQNNYLIKNKKNAQGN

SEQ ID NO: 3390180 - protein, 35 aa, Plasmodium falciparum
NKEIMKGYIKNFWYLSKKIFFGKYKNCAVSLENEE

SEQ ID NO: 3390181 - protein, 26 aa, Plasmodium falciparum
NKEITKLLLQYGAKIDDTDLSNRSAL

SEQ ID NO: 3390182 - protein, 28 aa, Plasmodium falciparum
NKEKKELLKTILKEKILILYNEQQNEEK

SEQ ID NO: 3390183 - protein, 33 aa, Plasmodium falciparum
NKEKKILYAGYEDAIILWSITNGIIISSFHGHT

SEQ ID NO: 3390184 - protein, 33 aa, Plasmodium falciparum; identical to SEQ ID NO: 3367955

SEQ ID NO: 3390185 - protein, 34 aa, Plasmodium falciparum
NKEMNNKLFLNIKEFIFKMHLNLENIKEMIKNKN

SEQ ID NO: 3390186 - protein, 26 aa, Plasmodium falciparum
NKENIKMTFNVTNRFTVLGCDWDNIS

SEQ ID NO: 3390187 - protein, 25 aa, Plasmodium falciparum
NKERFGTTPLYNHGYNNKFVDNRNN

SEQ ID NO: 3390188 - protein, 24 aa, Plasmodium falciparum
NKESYRKLLLGDLLNDDDFNEEKS

SEQ ID NO: 3390189 - protein, 26 aa, Plasmodium falciparum
NKEVYKWINVLLYEKKVRCIRTNNSH

SEQ ID NO: 3390190 - protein, 24 aa, Plasmodium falciparum
NKEVYVKNHFFFECVLVEEKYATI

SEQ ID NO: 3390191 - protein, 23 aa, Plasmodium falciparum
NKEYSKRKHTCAGLLTIVQVEDK

SEQ ID NO: 3390192 - protein, 17 aa, Plasmodium falciparum
NKEYTFLNFFKLKDLRE

SEQ ID NO: 3390193 - protein, 18 aa, Plasmodium falciparum
NKEYYFYGGFDLEEIYNI

SEQ ID NO: 3390194 - protein, 24 aa, Plasmodium falciparum
NKFEVIINPPFYLSVSSSIHSLKI

SEQ ID NO: 3390195 - protein, 22 aa, Plasmodium falciparum
NKFINEFIEYYKKLKGEYYITP

SEQ ID NO: 3390196 - protein, 24 aa, Plasmodium falciparum
NKFINKFHSVKILSTLKEFPVKKL

SEQ ID NO: 3390197 - protein, 20 aa, Plasmodium falciparum
NKFNDALSCLSKLQNLKGKK

SEQ ID NO: 3390198 - protein, 33 aa, Plasmodium falciparum
NKFQSDINSILFYYKRYYSLKKPLNEENIYNYI

SEQ ID NO: 3390199 - protein, 21 aa, Plasmodium falciparum
NKFYGLLHLIQKSRDKHIYSL

SEQ ID NO: 3390200 - protein, 20 aa, Plasmodium falciparum
NKGGLLLWSYNFYEIDDTTI

SEQ ID NO: 3390201 - protein, 26 aa, Plasmodium falciparum
NKGGRYFKVDKYFYSKKYKVRTHFGD

SEQ ID NO: 3390202 - protein, 25 aa, Plasmodium falciparum
NKGNLYKSRLALLKKNKVRISKAQE

SEQ ID NO: 3390203 - protein, 35 aa, Plasmodium falciparum
NKGSVILLIYDMNNVLFGYFLNKLHCDNCYYGSGE

SEQ ID NO: 3390204 - protein, 24 aa, Plasmodium falciparum
NKGYIKHIITYLQKVPMYVDVQII

SEQ ID NO: 3390205 - protein, 26 aa, Plasmodium falciparum
NKHASIVDIFYFCAIHKLLDEMAVKE

SEQ ID NO: 3390206 - protein, 24 aa, Plasmodium falciparum
NKHECILLPINGLHIPFHVSTIKN

SEQ ID NO: 3390207 - protein, 23 aa, Plasmodium falciparum
NKHFEKMYRNFLSYLNVEEYTRK

SEQ ID NO: 3390208 - protein, 26 aa, Plasmodium falciparum
NKHFHKHLFVHPTQKNLSSGKNNNNI

SEQ ID NO: 3390209 - protein, 25 aa, Plasmodium falciparum
NKHKQNISFLLNTQYRMNNLILLWS

SEQ ID NO: 3390210 - protein, 17 aa, Plasmodium falciparum
NKHNEHLINNKIKIIKN

SEQ ID NO: 3390211 - protein, 23 aa, Plasmodium falciparum
NKICQKFLTLPLNKKSDKLKDHS

SEQ ID NO: 3390212 - protein, 25 aa, Plasmodium falciparum
NKIDMESFKHCWKSFFLESDENSYE

SEQ ID NO: 3390213 - protein, 21 aa, Plasmodium falciparum
NKIHQIKILASYKLIDLHKSV

SEQ ID NO: 3390214 - protein, 31 aa, Plasmodium falciparum
NKIIECLIKLNIFLYLKKKKTYLYLYKQSLC

SEQ ID NO: 3390215 - protein, 21 aa, Plasmodium falciparum
NKIINIYKFHLIKYKWHSHSV

SEQ ID NO: 3390216 - protein, 29 aa, Plasmodium falciparum
NKIKEDIYYYILIPLIYKHIYDAYHIDIH

SEQ ID NO: 3390217 - protein, 46 aa, Plasmodium falciparum
NKIKKHIYKNYNNALVFLKKQIYKTNWLIHKNKKKLWESPYVHRFQ

SEQ ID NO: 3390218 - protein, 25 aa, Plasmodium falciparum
NKILKYIIHIFISDILKEKPNDVYD

SEQ ID NO: 3390219 - protein, 35 aa, Plasmodium falciparum
NKINKNYINQSMFLNSLHPNFSQKIFKEYSKQGPS

SEQ ID NO: 3390220 - protein, 21 aa, Plasmodium falciparum
NKIQHIFANIPYNNNFKKINQ

SEQ ID NO: 3390221 - protein, 23 aa, Plasmodium falciparum
NKIQKKLKKYVYLKDIYSTINMS

SEQ ID NO: 3390222 - protein, 25 aa, Plasmodium falciparum
NKIQNMWLHLTNNYSKYFIPRIPFK

SEQ ID NO: 3390223 - protein, 21 aa, Plasmodium falciparum
NKIRDAPHFLFTVLKELEISK

SEQ ID NO: 3390224 - protein, 36 aa, Plasmodium falciparum
NKISNKLLISATKFLKYFFPLLKVNVKESNAKYAWI

SEQ ID NO: 3390225 - protein, 34 aa, Plasmodium falciparum
NKIVELKKLLFNDLIYELGYILKNINLFYHSFQN

SEQ ID NO: 3390226 - protein, 18 aa, Plasmodium falciparum
NKIWNILPSILITGKGFP

SEQ ID NO: 3390227 - protein, 18 aa, Plasmodium falciparum
NKIYKYTAQLFIYNNTNN

SEQ ID NO: 3390228 - protein, 23 aa, Plasmodium falciparum
NKIYVIFKTLIKYNIYDMILLKK

SEQ ID NO: 3390229 - protein, 29 aa, Plasmodium falciparum
NKKACIYQFSFLLLLKKVYDIKQVYIYDP

SEQ ID NO: 3390230 - protein, 25 aa, Plasmodium falciparum
NKKEEKYYRYIPQNKLNNNLEERII

SEQ ID NO: 3390231 - protein, 36 aa, Plasmodium falciparum
NKKERINYMFVCPFIPNLIKWINVLKLSIKGKVSKK

SEQ ID NO: 3390232 - protein, 26 aa, Plasmodium falciparum
NKKEWTPFIHAPFFENQHNAIYKNRN

SEQ ID NO: 3390233 - protein, 23 aa, Plasmodium falciparum
NKKFKGIVLTPFCEKYFSIDDKY

SEQ ID NO: 3390234 - protein, 17 aa, Plasmodium falciparum
NKKFPPKLKAMKPKIKI

SEQ ID NO: 3390235 - protein, 31 aa, Plasmodium falciparum
NKKFVSKIGGKPFWLDRINLPDEKEFNCSVC

SEQ ID NO: 3390236 - protein, 23 aa, Plasmodium falciparum
NKKGLLEAYMRKYSNININGNNN

SEQ ID NO: 3390237 - protein, 17 aa, Plasmodium falciparum
NKKIHENFYLFRKKEKF

SEQ ID NO: 3390238 - protein, 32 aa, Plasmodium falciparum
NKKIPFTHTLTFSLIYYNYKLLPLSGNCPEER

SEQ ID NO: 3390239 - protein, 25 aa, Plasmodium falciparum
NKKISLFLELFLKYSKKLNLNIEIE

SEQ ID NO: 3390240 - protein, 28 aa, Plasmodium falciparum
NKKISNIFYMLLFYNSNHFIYNRMKNKQ

SEQ ID NO: 3390241 - protein, 23 aa, Plasmodium falciparum
NKKIYELINVWNPLSLKQSFHLS

SEQ ID NO: 3390242 - protein, 28 aa, Plasmodium falciparum
NKKKAIYLSIYEILGDTLIDLISNLNEK

SEQ ID NO: 3390243 - protein, 33 aa, Plasmodium falciparum
NKKKDECLLLTFSFKLFQLSKMHNKGKVLCVNK

SEQ ID NO: 3390244 - protein, 34 aa, Plasmodium falciparum
NKKKETCNLCIKSKIKLFLDEINFINNSLDIFEN

SEQ ID NO: 3390245 - protein, 24 aa, Plasmodium falciparum
NKKKHPMNILLNLNNKEKKKRSRN

SEQ ID NO: 3390246 - protein, 29 aa, Plasmodium falciparum
NKKKIKEIYKKIDSISLLNDLSLNKLESL

SEQ ID NO: 3390247 - protein, 23 aa, Plasmodium falciparum
NKKKKIINVIKDKYKKNIGRLLE

SEQ ID NO: 3390248 - protein, 25 aa, Plasmodium falciparum
NKKKKSWMIMIPPIKDRNNYNRNVS

SEQ ID NO: 3390249 - protein, 25 aa, Plasmodium falciparum
NKKKPLIDRSLIGKFSVEKYKSFLS

SEQ ID NO: 3390250 - protein, 19 aa, Plasmodium falciparum
NKKKYILIVNKKCLEKYSY

SEQ ID NO: 3390251 - protein, 22 aa, Plasmodium falciparum
NKKLQPHLSYQYKLIDYNNVSK

SEQ ID NO: 3390252 - protein, 21 aa, Plasmodium falciparum
NKKMECFLGDNFYIYLNINFI

SEQ ID NO: 3390253 - protein, 32 aa, Plasmodium falciparum
NKKNMNKSGPFYSYMHFIVNSNLKQKKKKEEY

SEQ ID NO: 3390254 - protein, 36 aa, Plasmodium falciparum
NKKNVIIHRDIKPENLIIDSDWNIHLCDFGDAEECE

SEQ ID NO: 3390255 - protein, 23 aa, Plasmodium falciparum
NKKQREVNFLGQKLEYKVVGNVI

SEQ ID NO: 3390256 - protein, 23 aa, Plasmodium falciparum
NKKRKLIKQYLLDNFISKKQKLI

SEQ ID NO: 3390257 - protein, 30 aa, Plasmodium falciparum
NKKSSCLINNKTLYFIYPPKNRSSCYGKTY

SEQ ID NO: 3390258 - protein, 19 aa, Plasmodium falciparum
NKKTRIKINMCENPCDIWY

SEQ ID NO: 3390259 - protein, 20 aa, Plasmodium falciparum
NKKVFLFDTTVMQKLNNLYY

SEQ ID NO: 3390260 - protein, 27 aa, Plasmodium falciparum
NKKYTFLKLYLPKYLCNSLIQIDLNIC

SEQ ID NO: 3390261 - protein, 20 aa, Plasmodium falciparum
NKLDCNLPYNLNLENIFWKQ

SEQ ID NO: 3390262 - protein, 24 aa, Plasmodium falciparum
NKLEPTWSLFVDNLKYMDLVPYDN

SEQ ID NO: 3390263 - protein, 19 aa, Plasmodium falciparum
NKLFKYFYDKCFNDICTYH

SEQ ID NO: 3390264 - protein, 24 aa, Plasmodium falciparum
NKLHLVRLIILTNCTFDGIVYNVK

SEQ ID NO: 3390265 - protein, 24 aa, Plasmodium falciparum
NKLHSVFKSFFNFSSLLFENIKPN

SEQ ID NO: 3390266 - protein, 24 aa, Plasmodium falciparum
NKLIEAFMLLANRSVARIIFQNFK

SEQ ID NO: 3390267 - protein, 18 aa, Plasmodium falciparum
NKLIILNKQYRCHPSISE

SEQ ID NO: 3390268 - protein, 23 aa, Plasmodium falciparum
NKLIRKYRCLINNPFVFVKNEMD

SEQ ID NO: 3390269 - protein, 35 aa, Plasmodium falciparum
NKLKEKILSILVYFLQSIFDCKILFFCPKEARNHF

SEQ ID NO: 3390270 - protein, 29 aa, Plasmodium falciparum
NKLKFDNFPVIRYYLYDVHFSIEEIKMII

SEQ ID NO: 3390271 - protein, 17 aa, Plasmodium falciparum
NKLKGYISNIGYGNLFN

SEQ ID NO: 3390272 - protein, 24 aa, Plasmodium falciparum
NKLKKYIKVVMWFGVPDSLACIRT

SEQ ID NO: 3390273 - protein, 19 aa, Plasmodium falciparum
NKLKLTYYKIYQKKTIKNI

SEQ ID NO: 3390274 - protein, 24 aa, Plasmodium falciparum
NKLKNFIFLMKNLYNLKLLEKLDV

SEQ ID NO: 3390275 - protein, 19 aa, Plasmodium falciparum
NKLKWKVLTIEYMDWKNKS

SEQ ID NO: 3390276 - protein, 29 aa, Plasmodium falciparum
NKLPSFDFINFYWIYGKVDKLLNIPNMKT

SEQ ID NO: 3390277 - protein, 20 aa, Plasmodium falciparum
NKLRDFFLFPYVDKNDKGYI

SEQ ID NO: 3390278 - protein, 33 aa, Plasmodium falciparum
NKLRGHCIIKNIFYMKGLKIENVPFASAGDIVN

SEQ ID NO: 3390279 - protein, 18 aa, Plasmodium falciparum
NKLRVEVPFNARENGRYN

SEQ ID NO: 3390280 - protein, 20 aa, Plasmodium falciparum
NKLVNYKNGLGGKNNNICIH

SEQ ID NO: 3390281 - protein, 26 aa, Plasmodium falciparum
NKLYDKWIMRMFAILKNDKKNQRLAV

SEQ ID NO: 3390282 - protein, 28 aa, Plasmodium falciparum
NKLYISLNEFIYFFSANEKMTKYNFAQE

SEQ ID NO: 3390283 - protein, 31 aa, Plasmodium falciparum
NKLYKKITDLFLLNLQIILKSDFVKLFNCLI

SEQ ID NO: 3390284 - protein, 30 aa, Plasmodium falciparum
NKMEPLYFNILFENTWFYEFFYYNHKDDNQ

SEQ ID NO: 3390285 - protein, 26 aa, Plasmodium falciparum
NKMGKNLLLYLKIIRNKIIPSSIEVL

SEQ ID NO: 3390286 - protein, 24 aa, Plasmodium falciparum
NKMIEKKYELLSNKFQDIYTTFND

SEQ ID NO: 3390287 - protein, 27 aa, Plasmodium falciparum
NKMKKDDLFVLPHTNTLLVDKKKNKKN

SEQ ID NO: 3390288 - protein, 24 aa, Plasmodium falciparum
NKMNPYLHRLPNDCLKKIDQDDSD

SEQ ID NO: 3390289 - protein, 22 aa, Plasmodium falciparum
NKMRLHIRLYGLNYSFNGINNM

SEQ ID NO: 3390290 - protein, 25 aa, Plasmodium falciparum
NKMRSAFNIYAETPGLKTIKKKNVL

SEQ ID NO: 3390291 - protein, 25 aa, Plasmodium falciparum
NKMVQIKCREALYDEIRECHSSTHI

SEQ ID NO: 3390292 - protein, 20 aa, Plasmodium falciparum
NKNDFVIMYSKIINIRFIYS

SEQ ID NO: 3390293 - protein, 23 aa, Plasmodium falciparum
NKNDILHYQVFAQKILSVTNIQN

SEQ ID NO: 3390294 - protein, 28 aa, Plasmodium falciparum
NKNENYLQNVWLFLFDNEVRKENDQCVG

SEQ ID NO: 3390295 - protein, 20 aa, Plasmodium falciparum
NKNIFLDHSVFLNYNKKVPK

SEQ ID NO: 3390296 - protein, 20 aa, Plasmodium falciparum
NKNIINLYENNFKSISQCPL

SEQ ID NO: 3390297 - protein, 21 aa, Plasmodium falciparum
NKNIKNLLAKGKKYIVCYNYL

SEQ ID NO: 3390298 - protein, 25 aa, Plasmodium falciparum
NKNILSYDPYKCKLLLLTRQNCNSN

SEQ ID NO: 3390299 - protein, 25 aa, Plasmodium falciparum
NKNIMYTYIKYKYMYDFYVQNKNIL

SEQ ID NO: 3390300 - protein, 28 aa, Plasmodium falciparum
NKNINENVIPFLLKKKLYEKNIAQIEQQ

SEQ ID NO: 3390301 - protein, 33 aa, Plasmodium falciparum
NKNINNILDYIKYIKYIKLGGKISMVKKKKRTD

SEQ ID NO: 3390302 - protein, 21 aa, Plasmodium falciparum
NKNINNLKLLKDYNLNDIVNN

SEQ ID NO: 3390303 - protein, 25 aa, Plasmodium falciparum
NKNINYLKNIFWTLSINYKINHIIK

SEQ ID NO: 3390304 - protein, 17 aa, Plasmodium falciparum
NKNITFYEKKTNISLCL

SEQ ID NO: 3390305 - protein, 27 aa, Plasmodium falciparum
NKNIYNVPLHMNNFYVPYNCNEPNMNT

SEQ ID NO: 3390306 - protein, 24 aa, Plasmodium falciparum
NKNKGEFVRYYNPNWWSLNNSIPN

SEQ ID NO: 3390307 - protein, 25 aa, Plasmodium falciparum
NKNKLFQKCYKWLKPTGTLLITDYC

SEQ ID NO: 3390308 - protein, 25 aa, Plasmodium falciparum
NKNKLPMSNPQNRKLYHACSSFKSE

SEQ ID NO: 3390309 - protein, 25 aa, Plasmodium falciparum
NKNKNDMYLYPQESHFKYVSERIEN

SEQ ID NO: 3390310 - protein, 31 aa, Plasmodium falciparum
NKNKRHIIMNMIFLIESFFNNTEKTRIPKEF

SEQ ID NO: 3390311 - protein, 31 aa, Plasmodium falciparum
NKNKYNYTFNRFLIPLNKLKLTYYKIYQKKT

SEQ ID NO: 3390312 - protein, 24 aa, Plasmodium falciparum
NKNLKRMRSIIKNKKKYLEDKMSN

SEQ ID NO: 3390313 - protein, 25 aa, Plasmodium falciparum
NKNMNNLYPWYNKICNMTLSSSITI

SEQ ID NO: 3390314 - protein, 27 aa, Plasmodium falciparum
NKNNFYLIYEYVNLGDLRTLLFNHYYY

SEQ ID NO: 3390315 - protein, 17 aa, Plasmodium falciparum
NKNNLDIHFLYEKTNEN

SEQ ID NO: 3390316 - protein, 19 aa, Plasmodium falciparum
NKNNLLFNCYNKYNNSEYS

SEQ ID NO: 3390317 - protein, 35 aa, Plasmodium falciparum
NKNNLLILNKKLVMFFLKYITFFVIENREIYLLST

SEQ ID NO: 3390318 - protein, 27 aa, Plasmodium falciparum
NKNNLYLLRYKHLLKALKYVKPSGMKE

SEQ ID NO: 3390319 - protein, 25 aa, Plasmodium falciparum
NKNNNYYYYYQYDYHKNECNRYYQY

SEQ ID NO: 3390320 - protein, 23 aa, Plasmodium falciparum
NKNNVLLLLTRDFRINDNWSLIY

SEQ ID NO: 3390321 - protein, 19 aa, Plasmodium falciparum
NKNRKFCFINYADAESAKN

SEQ ID NO: 3390322 - protein, 23 aa, Plasmodium falciparum
NKNSKMLELLKNEKLKIESENDI

SEQ ID NO: 3390323 - protein, 27 aa, Plasmodium falciparum
NKNSNTFIPIFFLNKVGDKFKNSENIY

SEQ ID NO: 3390324 - protein, 26 aa, Plasmodium falciparum
NKNTAKYIYKIKYNKLANIFNVNNMN

SEQ ID NO: 3390325 - protein, 20 aa, Plasmodium falciparum
NKNVFPIYNFNRYENFLINH

SEQ ID NO: 3390326 - protein, 19 aa, Plasmodium falciparum
NKNVLKKNILLEEEKKLEK

SEQ ID NO: 3390327 - protein, 30 aa, Plasmodium falciparum
NKNVNKYFHIYKHGIIKVFNFDFANMDANE

SEQ ID NO: 3390328 - protein, 21 aa, Plasmodium falciparum
NKNVPTFHTTWQNLSSSTNGN

SEQ ID NO: 3390329 - protein, 17 aa, Plasmodium falciparum
NKNWRLRYSMYYCLKFF

SEQ ID NO: 3390330 - protein, 24 aa, Plasmodium falciparum
NKNYDYFYYNKNCNLESSIKLKNN

SEQ ID NO: 3390331 - protein, 21 aa, Plasmodium falciparum
NKNYEYDLYILDEEKIQLHNY

SEQ ID NO: 3390332 - protein, 19 aa, Plasmodium falciparum
NKNYGVILLPEGLIEFVPE

SEQ ID NO: 3390333 - protein, 22 aa, Plasmodium falciparum
NKNYLIFIIYCLNKKNIVYLNF

SEQ ID NO: 3390334 - protein, 28 aa, Plasmodium falciparum
NKNYVKTNSILLKKILKMKIESMKKEKE

SEQ ID NO: 3390335 - protein, 26 aa, Plasmodium falciparum
NKPIFSIYILYIKGLCYFYLGDYEKS

SEQ ID NO: 3390336 - protein, 25 aa, Plasmodium falciparum
NKQGSAYLFLLKSQKQFLNILKNKN

SEQ ID NO: 3390337 - protein, 21 aa, Plasmodium falciparum
NKQIFYIDIICNFSINYKMCP

SEQ ID NO: 3390338 - protein, 22 aa, Plasmodium falciparum
NKQKLKIARYSWKAENPKAYVF

SEQ ID NO: 3390339 - protein, 25 aa, Plasmodium falciparum
NKQNAYLLDLLKKKSGYMVDNMKGE

SEQ ID NO: 3390340 - protein, 25 aa, Plasmodium falciparum
NKQNKVAYMIYLDSLFPSVKGNKIL

SEQ ID NO: 3390341 - protein, 25 aa, Plasmodium falciparum
NKRDAELMYLLKMLGRYNNENKKND

SEQ ID NO: 3390342 - protein, 40 aa, Plasmodium falciparum
NKRDEIISMIIELIKYISYMQKALIKASEGNFLIENPDIN

SEQ ID NO: 3390343 - protein, 23 aa, Plasmodium falciparum
NKREIWRVQYLLAKIRSAARYLL

SEQ ID NO: 3390344 - protein, 28 aa, Plasmodium falciparum
NKRKAKMWIGNYKILNPEDILCANVAEK

SEQ ID NO: 3390345 - protein, 34 aa, Plasmodium falciparum
NKRLHTMNMDSLKKINILSVRVKSLEKISKKYDQ

SEQ ID NO: 3390346 - protein, 24 aa, Plasmodium falciparum
NKRLKIYIIFELFQNKNIMKYFPS

SEQ ID NO: 3390347 - protein, 26 aa, Plasmodium falciparum
NKRNLFHQNFRSFIPINSIKSQGNHN

SEQ ID NO: 3390348 - protein, 32 aa, Plasmodium falciparum
NKRPMASVLLHHPWFQGYFDPIQISPNVLNNM

SEQ ID NO: 3390349 - protein, 24 aa, Plasmodium falciparum
NKRSLSTVELLKQDIKFLNEDVLK

SEQ ID NO: 3390350 - protein, 23 aa, Plasmodium falciparum
NKRTKKIVALKKLKNFSSMHNEG

SEQ ID NO: 3390351 - protein, 21 aa, Plasmodium falciparum
NKRVFVIYGSLPPDSKKKQIN

SEQ ID NO: 3390352 - protein, 18 aa, Plasmodium falciparum
NKRVIIKSVLFMDNTHKE

SEQ ID NO: 3390353 - protein, 34 aa, Plasmodium falciparum
NKSEEEILEHISWYKQFLVYNNLKNKYINTINII

SEQ ID NO: 3390354 - protein, 24 aa, Plasmodium falciparum
NKSIDDYFFIKLYGHFLKKECKIL

SEQ ID NO: 3390355 - protein, 31 aa, Plasmodium falciparum
NKSIKYYYNMLFTYFHFFLKYIKNTEHEKYC

SEQ ID NO: 3390356 - protein, 25 aa, Plasmodium falciparum
NKSKDDHFIFPSPDKNKNINKKNNN

SEQ ID NO: 3390357 - protein, 24 aa, Plasmodium falciparum
NKSNLFLQGNFFNSKNISPTYNQQ

SEQ ID NO: 3390358 - protein, 35 aa, Plasmodium falciparum
NKSNVNYSSYFFIPPLEFIVSHLNKLHKKNTYAYN

SEQ ID NO: 3390359 - protein, 20 aa, Plasmodium falciparum
NKSPQPIYVNSTRPNIIIKN

SEQ ID NO: 3390360 - protein, 21 aa, Plasmodium falciparum
NKSVCFLKRRNTCSFFDEKKY

SEQ ID NO: 3390361 - protein, 24 aa, Plasmodium falciparum
NKSWSYKANFILSSLYVTKEIQEY

SEQ ID NO: 3390362 - protein, 20 aa, Plasmodium falciparum
NKSYDILNDSNFNILENEGM

SEQ ID NO: 3390363 - protein, 27 aa, Plasmodium falciparum
NKTEQDVMILFFNSLETLHLRGNQLTN

SEQ ID NO: 3390364 - protein, 23 aa, Plasmodium falciparum
NKTFQYVCPSCEIVYCSVECYKL

SEQ ID NO: 3390365 - protein, 21 aa, Plasmodium falciparum
NKTKKITAVKTVKVIATEKKY

SEQ ID NO: 3390366 - protein, 25 aa, Plasmodium falciparum
NKTKSFYLYKYDYFGELSIINEQLR

SEQ ID NO: 3390367 - protein, 19 aa, Plasmodium falciparum
NKTLGTPITFLIYNEDIKK

SEQ ID NO: 3390368 - protein, 20 aa, Plasmodium falciparum
NKTLHVCLDYGLRLLHPISP

SEQ ID NO: 3390369 - protein, 17 aa, Plasmodium falciparum
NKTNFLKYPIYNNVNNI

SEQ ID NO: 3390370 - protein, 22 aa, Plasmodium falciparum
NKTNQLLKLYSNDKLNVLQYYD

SEQ ID NO: 3390371 - protein, 25 aa, Plasmodium falciparum
NKTQFNCFYIFKYIKHLYEELKNMK

SEQ ID NO: 3390372 - protein, 26 aa, Plasmodium falciparum
NKTRKLRNFLFYYRTNYGYINIKDFI

SEQ ID NO: 3390373 - protein, 23 aa, Plasmodium falciparum
NKTRMCYRNVPSFNYINNIDLLN

SEQ ID NO: 3390374 - protein, 32 aa, Plasmodium falciparum
NKTSNYYFNRVCLPICLILAPTRELAVQIFYD

SEQ ID NO: 3390375 - protein, 17 aa, Plasmodium falciparum
NKTSPTISFLNKTSMNN

SEQ ID NO: 3390376 - protein, 26 aa, Plasmodium falciparum
NKVERILRVELSPIQIEYYKNILTKN

SEQ ID NO: 3390377 - protein, 20 aa, Plasmodium falciparum
NKVIQNINLLKALNTNDQKV

SEQ ID NO: 3390378 - protein, 24 aa, Plasmodium falciparum
NKVNLYDLYPFYNPDQNYTRNERP

SEQ ID NO: 3390379 - protein, 23 aa, Plasmodium falciparum
NKVPILTDYVATRWYRAPEILLG

SEQ ID NO: 3390380 - protein, 24 aa, Plasmodium falciparum
NKVQNNMFLLYGNIIKVLDIGVGA

SEQ ID NO: 3390381 - protein, 22 aa, Plasmodium falciparum
NKVYIFGLCLNLKNPDEMKIFL

SEQ ID NO: 3390382 - protein, 24 aa, Plasmodium falciparum
NKYAPNVQYLLDTYIKLFCLAGNF

SEQ ID NO: 3390383 - protein, 23 aa, Plasmodium falciparum
NKYDKYHRYNKYNNYLSTLSYSN

SEQ ID NO: 3390384 - protein, 25 aa, Plasmodium falciparum
NKYEALLKSLIATGMKLPKKSILIS

SEQ ID NO: 3390385 - protein, 24 aa, Plasmodium falciparum
NKYEKTCFFPARKQPIYTIINTKR

SEQ ID NO: 3390386 - protein, 38 aa, Plasmodium falciparum
NKYFEQFNNSLFLFLNDKQKLYRFALTITLTSIGIYTT

SEQ ID NO: 3390387 - protein, 36 aa, Plasmodium falciparum
NKYFLKCDKYYMKYKNGKFILYFNDFEDQHVVIPQN

SEQ ID NO: 3390388 - protein, 26 aa, Plasmodium falciparum
NKYFSEYFSLLFKNRKASLVLKKMNE

SEQ ID NO: 3390389 - protein, 33 aa, Plasmodium falciparum
NKYGINFELLNFNYYNFATLYDYNNIDGAFFKN

SEQ ID NO: 3390390 - protein, 19 aa, Plasmodium falciparum
NKYICIMDMIKCRDKTIYK

SEQ ID NO: 3390391 - protein, 48 aa, Plasmodium falciparum
NKYIKSINRDHFKKYFFLLLYRYHISRHTYPNYVFPDIKMVNTNLSLH

SEQ ID NO: 3390392 - protein, 25 aa, Plasmodium falciparum
NKYILNKLILIFNNNIKCIPPNEET

SEQ ID NO: 3390393 - protein, 23 aa, Plasmodium falciparum
NKYKKLNDLLNKAQMKIITLTRA

SEQ ID NO: 3390394 - protein, 25 aa, Plasmodium falciparum
NKYKLYTMPDQYKIGYFDVTSPNDM

SEQ ID NO: 3390395 - protein, 24 aa, Plasmodium falciparum
NKYKSILISVIDFMDKLKIVDAHM

SEQ ID NO: 3390396 - protein, 25 aa, Plasmodium falciparum
NKYNKNGFVYDYNTYYTKKSSDLKG

SEQ ID NO: 3390397 - protein, 18 aa, Plasmodium falciparum
NKYNLQINLLKEKIKKEN

SEQ ID NO: 3390398 - protein, 21 aa, Plasmodium falciparum
NKYSRTFNFYNKNEKRKYYEN

SEQ ID NO: 3390399 - protein, 24 aa, Plasmodium falciparum
NKYTKMYTLIKLLLDDIPNKDMLS

SEQ ID NO: 3390400 - protein, 27 aa, Plasmodium falciparum
NKYYGIRGLIILPTKELVIQIYKLCKK

SEQ ID NO: 3390401 - protein, 17 aa, Plasmodium falciparum
NKYYKCSFYVDKNINNI

SEQ ID NO: 3390402 - protein, 23 aa, Plasmodium falciparum
NLAKQFKFLPSDVTKYFIEGDNV

SEQ ID NO: 3390403 - protein, 17 aa, Plasmodium falciparum
NLAKRDNNWRLEIVKFC

SEQ ID NO: 3390404 - protein, 19 aa, Plasmodium falciparum
NLALAKYPPNPSLYEGNLY

SEQ ID NO: 3390405 - protein, 18 aa, Plasmodium falciparum
NLALIGNGFLISAFVIYP

SEQ ID NO: 3390406 - protein, 25 aa, Plasmodium falciparum
NLCLELYHLQFFDPINKDYIKIENS

SEQ ID NO: 3390407 - protein, 20 aa, Plasmodium falciparum
NLCSSIIQIYFPFGKGNNYK

SEQ ID NO: 3390408 - protein, 17 aa, Plasmodium falciparum
NLDDILNYKTKDFNNND

SEQ ID NO: 3390409 - protein, 19 aa, Plasmodium falciparum
NLDDILNYKTKDFNNNDDI

SEQ ID NO: 3390410 - protein, 17 aa, Plasmodium falciparum
NLDIHFLYEKTNENNVD

SEQ ID NO: 3390411 - protein, 49 aa, Plasmodium falciparum
NLDIHRLNKYLFLFRVFQAEILMFFHINAWNNLYLKKYNKIFLQYFDDT

SEQ ID NO: 3390412 - protein, 17 aa, Plasmodium falciparum
NLDILMNLKILILDEAD

SEQ ID NO: 3390413 - protein, 31 aa, Plasmodium falciparum
NLDIYLKNLLLNFLNYIYQGSYILTTHDFYI

SEQ ID NO: 3390414 - protein, 20 aa, Plasmodium falciparum
NLEDFDCIYFLSSNIQSVDI

SEQ ID NO: 3390415 - protein, 28 aa, Plasmodium falciparum
NLEDNCHDILFFFDSYVKKNKKEKMKNS

SEQ ID NO: 3390416 - protein, 35 aa, Plasmodium falciparum
NLEEESVKAHFILGLTLLHLNSLEEGLKKLTKAKT

SEQ ID NO: 3390417 - protein, 20 aa, Plasmodium falciparum
NLEFIACFTYLYTYINVSNA

SEQ ID NO: 3390418 - protein, 18 aa, Plasmodium falciparum
NLEFLKNDKKKKFQNIFY

SEQ ID NO: 3390419 - protein, 25 aa, Plasmodium falciparum
NLEFQKKFILHKMNDYFKNINATNE

SEQ ID NO: 3390420 - protein, 30 aa, Plasmodium falciparum
NLEGNDPTSFDLIQKLKIVQKKLIEKTEES

SEQ ID NO: 3390421 - protein, 21 aa, Plasmodium falciparum
NLEHCSIVELVYRCISLLPKH

SEQ ID NO: 3390422 - protein, 48 aa, Plasmodium falciparum
NLEIFYHISNFIIHRYWYSQEYSTYNIFIWFLNYMHSKLEIRKSIQKI

SEQ ID NO: 3390423 - protein, 24 aa, Plasmodium falciparum
NLEIKYNFLNIYASLRNEYIVVRT

SEQ ID NO: 3390424 - protein, 36 aa, Plasmodium falciparum
NLEKEEKYILLLYISEKKLEYVWNEREAFKRAHSNI

SEQ ID NO: 3390425 - protein, 22 aa, Plasmodium falciparum
NLEKKFIKYLNFVKYHKLDISQ

SEQ ID NO: 3390426 - protein, 32 aa, Plasmodium falciparum
NLEKSYEHLLKEKKLYELKLNQALISLQEINE

SEQ ID NO: 3390427 - protein, 36 aa, Plasmodium falciparum
NLELYEPLFTNYTSNFIGCLDYIFYNDENLNIISTV

SEQ ID NO: 3390428 - protein, 22 aa, Plasmodium falciparum
NLENLILNFQLSKKNIICDHKK

SEQ ID NO: 3390429 - protein, 24 aa, Plasmodium falciparum
NLENYNIIDSTKYIFQENTKDISN

SEQ ID NO: 3390430 - protein, 20 aa, Plasmodium falciparum
NLFIFHVPNEWQQTDLIQAF

SEQ ID NO: 3390431 - protein, 17 aa, Plasmodium falciparum
NLFIKICHNISLCYYFL

SEQ ID NO: 3390432 - protein, 18 aa, Plasmodium falciparum
NLFIYAKNIMECDKVHNF

SEQ ID NO: 3390433 - protein, 17 aa, Plasmodium falciparum
NLFLKSLISNNFIPDHL

SEQ ID NO: 3390434 - protein, 19 aa, Plasmodium falciparum
NLFSYDQILFDYISKIIAV

SEQ ID NO: 3390435 - protein, 24 aa, Plasmodium falciparum
NLGDLRTLLFNHYYYYNSKNKENP

SEQ ID NO: 3390436 - protein, 25 aa, Plasmodium falciparum
NLGRIPLMLKSMFCWTKGLPENEIA

SEQ ID NO: 3390437 - protein, 19 aa, Plasmodium falciparum
NLGYIIKDIIPLDTFPRTP

SEQ ID NO: 3390438 - protein, 29 aa, Plasmodium falciparum
NLHDRNTSRIYGRGIRTNSSSYYNILENF

SEQ ID NO: 3390439 - protein, 19 aa, Plasmodium falciparum
NLHILLTKVKKGESWNSVF

SEQ ID NO: 3390440 - protein, 18 aa, Plasmodium falciparum
NLHKLRKAFFYSRVVINN

SEQ ID NO: 3390441 - protein, 35 aa, Plasmodium falciparum
NLHKNNIHQIYFMKKRKIFINNMKGLQFNKNSFNT

SEQ ID NO: 3390442 - protein, 47 aa, Plasmodium falciparum
NLHNTSWFCMIFDFDGISKLLNVFNKYLIYSDALIIPDTLLSNKTEA

SEQ ID NO: 3390443 - protein, 25 aa, Plasmodium falciparum
NLIDMLHIHDIYFLSSWKIKTAILK

SEQ ID NO: 3390444 - protein, 24 aa, Plasmodium falciparum
NLIEEFMDLFIVIKLIKNAKHKEC

SEQ ID NO: 3390445 - protein, 25 aa, Plasmodium falciparum
NLIFDKWTILRLAVTNNWGGINSED

SEQ ID NO: 3390446 - protein, 18 aa, Plasmodium falciparum
NLIIPKELKYDLLQYQKE

SEQ ID NO: 3390447 - protein, 23 aa, Plasmodium falciparum
NLIKLEIEFVSTMNLLTFEELKE

SEQ ID NO: 3390448 - protein, 27 aa, Plasmodium falciparum
NLIKQSLPKGIYYDHAKKLYRVQYIIN

SEQ ID NO: 3390449 - protein, 25 aa, Plasmodium falciparum
NLIQREMLLLIKNDMFNYPLRNSTP

SEQ ID NO: 3390450 - protein, 29 aa, Plasmodium falciparum
NLIVGKSYCFIFYLINFDFIDIHFEFDKN

SEQ ID NO: 3390451 - protein, 21 aa, Plasmodium falciparum
NLIVQIWANSYILKTKKKVAY

SEQ ID NO: 3390452 - protein, 25 aa, Plasmodium falciparum
NLKDKNFVLKRDRYALLGKIKNNKE

SEQ ID NO: 3390453 - protein, 21 aa, Plasmodium falciparum
NLKDNINIPYTSKELYTYKEY

SEQ ID NO: 3390454 - protein, 27 aa, Plasmodium falciparum
NLKEKNMRWVMCKSLKQARLGLATIVF

SEQ ID NO: 3390455 - protein, 18 aa, Plasmodium falciparum
NLKFKQMSNIPIVKETRK

SEQ ID NO: 3390456 - protein, 18 aa, Plasmodium falciparum
NLKGNNDSLYPFLNEQSK

SEQ ID NO: 3390457 - protein, 25 aa, Plasmodium falciparum
NLKGNVIYPPKFPAVSNFSSNRPYL

SEQ ID NO: 3390458 - protein, 21 aa, Plasmodium falciparum
NLKILYDYYLKIQSTVGVTEC

SEQ ID NO: 3390459 - protein, 20 aa, Plasmodium falciparum
NLKIWNKLFKKKPVLMKVRL

SEQ ID NO: 3390460 - protein, 20 aa, Plasmodium falciparum
NLKKCFYMCNSCSKKFNYMR

SEQ ID NO: 3390461 - protein, 31 aa, Plasmodium falciparum
NLKKFDFFYQSLISDILFIAKSHIKNIGANL

SEQ ID NO: 3390462 - protein, 17 aa, Plasmodium falciparum
NLKKLCIYISDSELSQP

SEQ ID NO: 3390463 - protein, 24 aa, Plasmodium falciparum
NLKKVFVLIDCRVGLKTSDKELLH

SEQ ID NO: 3390464 - protein, 17 aa, Plasmodium falciparum
NLKMHDLHNLKSYDFGL

SEQ ID NO: 3390465 - protein, 25 aa, Plasmodium falciparum
NLKNGPSFSFFYEYAHDRSILSLSL

SEQ ID NO: 3390466 - protein, 24 aa, Plasmodium falciparum
NLKNKIDLSFYSKILLVGAYLASR

SEQ ID NO: 3390467 - protein, 19 aa, Plasmodium falciparum
NLKNNIFWNIAISHVERVK

SEQ ID NO: 3390468 - protein, 18 aa, Plasmodium falciparum
NLKNYYMPKETIYNDIEN

SEQ ID NO: 3390469 - protein, 19 aa, Plasmodium falciparum
NLKPLIIKIRKDKLSKEEK

SEQ ID NO: 3390470 - protein, 24 aa, Plasmodium falciparum
NLKPPSLYLPKIGDIVICKVQRVS

SEQ ID NO: 3390471 - protein, 25 aa, Plasmodium falciparum
NLKSLKYLFKVGDILNIYGAVTTWS

SEQ ID NO: 3390472 - protein, 17 aa, Plasmodium falciparum
NLKSVVGTPYYIAPEIL

SEQ ID NO: 3390473 - protein, 68 aa, Plasmodium falciparum
NLKVILNVLLSNVYCFFEIKLTIILLNFFISNNCQWSFSLFPLSLINKLIHKFSLKINKKVPKYKLEN

SEQ ID NO: 3390474 - protein, 17 aa, Plasmodium falciparum
NLLCNFMCYIMGNLFNT

SEQ ID NO: 3390475 - protein, 18 aa, Plasmodium falciparum
NLLKSKYNYKKKKKSRYC

SEQ ID NO: 3390476 - protein, 17 aa, Plasmodium falciparum
NLLKYRYVVFTYKALKN

SEQ ID NO: 3390477 - protein, 22 aa, Plasmodium falciparum
NLLLDNLVNCEIIILDILSSVL

SEQ ID NO: 3390478 - protein, 33 aa, Plasmodium falciparum
NLLNKSTFFNKDSIFGTALLKNDYIFSTDEKYN

SEQ ID NO: 3390479 - protein, 21 aa, Plasmodium falciparum
NLLNNIKNFKDILNLSQESLN

SEQ ID NO: 3390480 - protein, 24 aa, Plasmodium falciparum
NLLQPFQDYFEKTNFLRKDKIFID

SEQ ID NO: 3390481 - protein, 23 aa, Plasmodium falciparum
NLLSNWLEIFKIIKLAKKLSYLN

SEQ ID NO: 3390482 - protein, 25 aa, Plasmodium falciparum
NLLVQYHFNIFIPYDYIYYTTYKKM

SEQ ID NO: 3390483 - protein, 29 aa, Plasmodium falciparum
NLMDRIYAGYIYHGYFKVSFKDYVVSNRT

SEQ ID NO: 3390484 - protein, 24 aa, Plasmodium falciparum
NLMLKIIYCMVPVFNMNIYNYSIV

SEQ ID NO: 3390485 - protein, 30 aa, Plasmodium falciparum
NLNCYHYFFHLKHIFKIIKGIFLSEAPIYE

SEQ ID NO: 3390486 - protein, 27 aa, Plasmodium falciparum
NLNDKRIRALLYIFKYIKNLEKKKEHN

SEQ ID NO: 3390487 - protein, 33 aa, Plasmodium falciparum
NLNDLLDKNNFSYKLYLLSLMQDKNKNLQTEQL

SEQ ID NO: 3390488 - protein, 28 aa, Plasmodium falciparum
NLNEENWNIFWEWLYENDDINISTFKKH

SEQ ID NO: 3390489 - protein, 24 aa, Plasmodium falciparum
NLNENLIFIKSLIIVPTNELACQI

SEQ ID NO: 3390490 - protein, 24 aa, Plasmodium falciparum
NLNEPFKFFIGGIPQYITSKHITE

SEQ ID NO: 3390491 - protein, 17 aa, Plasmodium falciparum
NLNFIGAAAAPNPPKEA

SEQ ID NO: 3390492 - protein, 19 aa, Plasmodium falciparum
NLNIVPYLNLYMCRIKDDD

SEQ ID NO: 3390493 - protein, 19 aa, Plasmodium falciparum
NLNKFFKEFLKNDTTYFKN

SEQ ID NO: 3390494 - protein, 29 aa, Plasmodium falciparum
NLNKKGIIPPILFLPLIDYEQFKYFVKVM

SEQ ID NO: 3390495 - protein, 24 aa, Plasmodium falciparum
NLNLKPYLKIIKDFDKYPIIVDSN

SEQ ID NO: 3390496 - protein, 22 aa, Plasmodium falciparum
NLNMPTFEKFINKYHIFRTCHN

SEQ ID NO: 3390497 - protein, 20 aa, Plasmodium falciparum
NLNNLCTINNIYTKLYDEHI

SEQ ID NO: 3390498 - protein, 23 aa, Plasmodium falciparum
NLNNLLEFFKRYEKQIDQEKCNK

SEQ ID NO: 3390499 - protein, 18 aa, Plasmodium falciparum
NLNNNIPPVFKYDDIINN

SEQ ID NO: 3390500 - protein, 18 aa, Plasmodium falciparum
NLNNNNMYSTYNSPPGLA

SEQ ID NO: 3390501 - protein, 39 aa, Plasmodium falciparum
NLNNYSKYLFIYKLDIYYKYFQSFIYDLLNIHKHIYIEK

SEQ ID NO: 3390502 - protein, 32 aa, Plasmodium falciparum
NLNQLDLFHILKKIKMFLYDKEIKKLYNHFND

SEQ ID NO: 3390503 - protein, 18 aa, Plasmodium falciparum
NLNSFQKLIIIKILRPDR

SEQ ID NO: 3390504 - protein, 18 aa, Plasmodium falciparum
NLNTLYQCLYISIQIKNR

SEQ ID NO: 3390505 - protein, 19 aa, Plasmodium falciparum
NLNYCHVINVGSNNPYDNN

SEQ ID NO: 3390506 - protein, 29 aa, Plasmodium falciparum
NLPAALLTRFDLQFLLLDVSDREKDKKLA

SEQ ID NO: 3390507 - protein, 21 aa, Plasmodium falciparum
NLPKIPLPDKLAKKEKKKKLK

SEQ ID NO: 3390508 - protein, 18 aa, Plasmodium falciparum
NLPNIKYYKNIPSNICKL

SEQ ID NO: 3390509 - protein, 25 aa, Plasmodium falciparum
NLPYNLNLENIFWKQINLKNYKKKY

SEQ ID NO: 3390510 - protein, 34 aa, Plasmodium falciparum
NLQFIPQHQPLFDLLLIFYKYTINEFLVFKNKHG

SEQ ID NO: 3390511 - protein, 20 aa, Plasmodium falciparum
NLQHFTIYIDMKKIKSTTFQ

SEQ ID NO: 3390512 - protein, 18 aa, Plasmodium falciparum
NLQKITCLNWNKKVSHIL

SEQ ID NO: 3390513 - protein, 17 aa, Plasmodium falciparum
NLQKMEIMNLFKKIMHA

SEQ ID NO: 3390514 - protein, 29 aa, Plasmodium falciparum
NLQVNNIQFLFFDPIYVSSKKYVHFYPSH

SEQ ID NO: 3390515 - protein, 36 aa, Plasmodium falciparum
NLRFDIDEIYTFTGPILIAVNPFKIIKDLYSDNMLA

SEQ ID NO: 3390516 - protein, 31 aa, Plasmodium falciparum
NLRGYDYQYSPLFYSYLLFQFDREEQDFSKI

SEQ ID NO: 3390517 - protein, 30 aa, Plasmodium falciparum
NLRTLNLRKNNLIYFPYISNFVLDGLVNIH

SEQ ID NO: 3390518 - protein, 20 aa, Plasmodium falciparum
NLSCYISMKDYNFNSSIRIC

SEQ ID NO: 3390519 - protein, 30 aa, Plasmodium falciparum
NLSEKIKRDIIIKNVLRKINTLITNFKMNK

SEQ ID NO: 3390520 - protein, 25 aa, Plasmodium falciparum
NLSGEVFFPSRRLGICFRGLDGYYR

SEQ ID NO: 3390521 - protein, 37 aa, Plasmodium falciparum
NLSIGKIDLSNIYMDILHIHETLVNHIQTIVTQVYSL

SEQ ID NO: 3390522 - protein, 23 aa, Plasmodium falciparum
NLSIKNLWRRVYNSADIDYIYIK

SEQ ID NO: 3390523 - protein, 18 aa, Plasmodium falciparum
NLSKFVLNSFLNNNDFNI

SEQ ID NO: 3390524 - protein, 24 aa, Plasmodium falciparum
NLSKIPYIYSCRKYDDYYYNYYKQ

SEQ ID NO: 3390525 - protein, 18 aa, Plasmodium falciparum
NLSKTLSVLLVLNAIRIE

SEQ ID NO: 3390526 - protein, 34 aa, Plasmodium falciparum
NLSLLNTCLFVNNFLKITILGVHSYITVGQIILT

SEQ ID NO: 3390527 - protein, 27 aa, Plasmodium falciparum
NLSNNKTYLNLFRPYKIEVDSFTSFKD

SEQ ID NO: 3390528 - protein, 23 aa, Plasmodium falciparum
NLSNSQMTLKLRKLAYANNIKES

SEQ ID NO: 3390529 - protein, 33 aa, Plasmodium falciparum
NLSNVKLKYINIITYYMDLLSPFNKCYSEKNGT

SEQ ID NO: 3390530 - protein, 23 aa, Plasmodium falciparum
NLSPRFKAFVQLKEFLMNEHKKY

SEQ ID NO: 3390531 - protein, 20 aa, Plasmodium falciparum
NLSTHQKFDLLIDEYYCDLK

SEQ ID NO: 3390532 - protein, 25 aa, Plasmodium falciparum
NLSTLNILYMWKSYRSAFMSFIQKQ

SEQ ID NO: 3390533 - protein, 18 aa, Plasmodium falciparum
NLSTRFIKYVIKSYKRTC

SEQ ID NO: 3390534 - protein, 26 aa, Plasmodium falciparum
NLTHNLYQWMTFQLKHFANIFCNGRI

SEQ ID NO: 3390535 - protein, 25 aa, Plasmodium falciparum
NLTKEQMLYLIRNILMSIEDYLKKE

SEQ ID NO: 3390536 - protein, 31 aa, Plasmodium falciparum
NLTNSLFQSFPMEQNLPLFKYKKENKQDYDN

SEQ ID NO: 3390537 - protein, 31 aa, Plasmodium falciparum
NLTPDQISALNAHLPNEINIETITSTLTTNN

SEQ ID NO: 3390538 - protein, 27 aa, Plasmodium falciparum
NLTTSNFNYNLINYSYEPFYEENLMND

SEQ ID NO: 3390539 - protein, 21 aa, Plasmodium falciparum
NLVFSFMYYFHMKKLHYDNIK

SEQ ID NO: 3390540 - protein, 24 aa, Plasmodium falciparum
NLVIDTFITYILSQVPKDIKEIEL

SEQ ID NO: 3390541 - protein, 50 aa, Plasmodium falciparum
NLVNNTKIIYIYNTTLEWFLKCIALIQHNIRKWLVKRKILRIHNIKKKNK

SEQ ID NO: 3390542 - protein, 17 aa, Plasmodium falciparum
NLVPYFNGRIFLENKEE

SEQ ID NO: 3390543 - protein, 20 aa, Plasmodium falciparum
NLYANIYYKLGNICTLLLKS

SEQ ID NO: 3390544 - protein, 33 aa, Plasmodium falciparum
NLYDDDIMKIIFNYFYILKDNKFIKLKEFIKFN

SEQ ID NO: 3390545 - protein, 24 aa, Plasmodium falciparum
NLYDIHIYNIYKWTMYSSIASTFI

SEQ ID NO: 3390546 - protein, 17 aa, Plasmodium falciparum
NLYIEEIKYFWNHYKKN

SEQ ID NO: 3390547 - protein, 24 aa, Plasmodium falciparum
NLYKEYLFYFETFKRKKLLKDKKK

SEQ ID NO: 3390548 - protein, 21 aa, Plasmodium falciparum
NLYLYILNVFCNTVQMIKKCD

SEQ ID NO: 3390549 - protein, 42 aa, Plasmodium falciparum
NLYNDDLLDIYKYTTDIYTPKPKLFVYSLKNNLNTNHEIHKN

SEQ ID NO: 3390550 - protein, 27 aa, Plasmodium falciparum
NLYNNTIYKTLLYILKNTNNEINKKIY

SEQ ID NO: 3390551 - protein, 17 aa, Plasmodium falciparum
NLYNRQIYPPINVLPSL

SEQ ID NO: 3390552 - protein, 19 aa, Plasmodium falciparum
NLYQPLTIYDVLAFQYDQI

SEQ ID NO: 3390553 - protein, 46 aa, Plasmodium falciparum
NLYSTFQLVQKTVSINFKKLKIQFKKTGQFLIPDNLSQSFGNMKNF

SEQ ID NO: 3390554 - protein, 20 aa, Plasmodium falciparum
NMCEDLSSFKIPQNKITKLI

SEQ ID NO: 3390555 - protein, 19 aa, Plasmodium falciparum
NMCLNFFDIIHKITKLSSI

SEQ ID NO: 3390556 - protein, 23 aa, Plasmodium falciparum
NMDNIHTKYLRVIEIVSLESINH

SEQ ID NO: 3390557 - protein, 24 aa, Plasmodium falciparum
NMDNKTWLKVSQYLDMEKGEYFKE

SEQ ID NO: 3390558 - protein, 18 aa, Plasmodium falciparum
NMEMSILYNDRIVNNNNK

SEQ ID NO: 3390559 - protein, 24 aa, Plasmodium falciparum
NMEQNNIKLFKRNIKNNTTKYINK

SEQ ID NO: 3390560 - protein, 18 aa, Plasmodium falciparum
NMGFIPNNQFMHPQVYHP

SEQ ID NO: 3390561 - protein, 22 aa, Plasmodium falciparum
NMGFNFYIINLGGGYPEELEYD

SEQ ID NO: 3390562 - protein, 25 aa, Plasmodium falciparum
NMHIFTSRFLFIGKNINMEDIKNKL

SEQ ID NO: 3390563 - protein, 18 aa, Plasmodium falciparum
NMHILRAIEMLPTCNNGN

SEQ ID NO: 3390564 - protein, 25 aa, Plasmodium falciparum
NMIMRQIIPILLKSTNMEFLIFLSN

SEQ ID NO: 3390565 - protein, 24 aa, Plasmodium falciparum
NMINYNHLVLLYGPPGTGKTSLCK

SEQ ID NO: 3390566 - protein, 18 aa, Plasmodium falciparum
NMIPLYYNKNINYLEPYE

SEQ ID NO: 3390567 - protein, 30 aa, Plasmodium falciparum
NMIQLKSFHLYKLISFPDYNIYQIKTKFYL

SEQ ID NO: 3390568 - protein, 20 aa, Plasmodium falciparum
NMIQNERVNYILPSLNKNLS

SEQ ID NO: 3390569 - protein, 19 aa, Plasmodium falciparum
NMKEMYLTYDASHSDISDG

SEQ ID NO: 3390570 - protein, 17 aa, Plasmodium falciparum
NMKFSIYGSLYVLNFFS

SEQ ID NO: 3390571 - protein, 18 aa, Plasmodium falciparum
NMKGKTFTLKKLIGIKKN

SEQ ID NO: 3390572 - protein, 18 aa, Plasmodium falciparum
NMKHTIIFDYVENEKDKN

SEQ ID NO: 3390573 - protein, 45 aa, Plasmodium falciparum
NMKHYKVLIHAPACWKGEKFNGTPFIFVYDKSINFYTYSESPLEI

SEQ ID NO: 3390574 - protein, 29 aa, Plasmodium falciparum
NMKKNIRINKNYFPKGITSPRNNGNTNDT

SEQ ID NO: 3390575 - protein, 21 aa, Plasmodium falciparum
NMKKYSPYLPHTYITEDNNIL

SEQ ID NO: 3390576 - protein, 17 aa, Plasmodium falciparum
NMLMLKGTYHGDSLNES

SEQ ID NO: 3390577 - protein, 33 aa, Plasmodium falciparum
NMLNYIHIKKYKPLIIYFFNNLAQNLKKMKNND

SEQ ID NO: 3390578 - protein, 20 aa, Plasmodium falciparum
NMMALWIKSRIHYNNTFFPL

SEQ ID NO: 3390579 - protein, 27 aa, Plasmodium falciparum
NMMDYMTKGTLLFKKSTKLKNKNKKKK

SEQ ID NO: 3390580 - protein, 19 aa, Plasmodium falciparum
NMMLNNFHKNNIPQGYRDE

SEQ ID NO: 3390581 - protein, 18 aa, Plasmodium falciparum
NMMMSHVDGMYIPGTYMS

SEQ ID NO: 3390582 - protein, 26 aa, Plasmodium falciparum
NMNAGQLVVLPLYSSLPPAQQQKIFE

SEQ ID NO: 3390583 - protein, 22 aa, Plasmodium falciparum
NMNEIDILNFLHMEHKKNMSLT

SEQ ID NO: 3390584 - protein, 17 aa, Plasmodium falciparum
NMNIFPMNRRRNHINRI

SEQ ID NO: 3390585 - protein, 17 aa, Plasmodium falciparum
NMNIYTNKYSRALDIND

SEQ ID NO: 3390586 - protein, 18 aa, Plasmodium falciparum
NMNKNLIYYGKNSNLLNN

SEQ ID NO: 3390587 - protein, 23 aa, Plasmodium falciparum
NMNKYNIHMNINNKIPNKFDANE

SEQ ID NO: 3390588 - protein, 23 aa, Plasmodium falciparum
NMNNIIYKNPPRNYMNNEIIVNT

SEQ ID NO: 3390589 - protein, 25 aa, Plasmodium falciparum
NMNNPINFILFKDVMLNICKFSRIF

SEQ ID NO: 3390590 - protein, 25 aa, Plasmodium falciparum
NMNNSEIFLFYKCTQYLNSFIFTYL

SEQ ID NO: 3390591 - protein, 23 aa, Plasmodium falciparum
NMNNSYLDDFYLFKNNTSNHEYS

SEQ ID NO: 3390592 - protein, 27 aa, Plasmodium falciparum
NMNYCFKYLYYYFTIHQQIVISNNFVL

SEQ ID NO: 3390593 - protein, 17 aa, Plasmodium falciparum
NMNYLNGYFISFNMYYL

SEQ ID NO: 3390594 - protein, 24 aa, Plasmodium falciparum
NMSKIYKTLIKFKNSILSKDLPNI

SEQ ID NO: 3390595 - protein, 25 aa, Plasmodium falciparum
NMSKNDVLILLSFNNNYLAEEKVKE

SEQ ID NO: 3390596 - protein, 27 aa, Plasmodium falciparum
NMSNMNNRLYLLNKRSSLNNNYSPNNI

SEQ ID NO: 3390597 - protein, 17 aa, Plasmodium falciparum
NMTSDNLFFNLKNDNLY

SEQ ID NO: 3390598 - protein, 29 aa, Plasmodium falciparum
NMTSLKNMKYNKMLPLKPDYNVGNDKEHI

SEQ ID NO: 3390599 - protein, 17 aa, Plasmodium falciparum
NMYENIIKSCRNYDLLY

SEQ ID NO: 3390600 - protein, 25 aa, Plasmodium falciparum
NMYKCKPFADELNQCLTRHSDISLC

SEQ ID NO: 3390601 - protein, 33 aa, Plasmodium falciparum
NMYKNNGTYIYKYISMLLYTTNNDIFYTPKQLQ

SEQ ID NO: 3390602 - protein, 24 aa, Plasmodium falciparum
NMYNSIEQYTFYHDTRNNHLVDKN

SEQ ID NO: 3390603 - protein, 27 aa, Plasmodium falciparum
NNAENLFKISYSCNDLVLGKNNEIILD

SEQ ID NO: 3390604 - protein, 20 aa, Plasmodium falciparum
NNAETPLWMQGMEPQLIHIC

SEQ ID NO: 3390605 - protein, 26 aa, Plasmodium falciparum
NNAFRLCQYRLMVEKLSTLQVSGKEI

SEQ ID NO: 3390606 - protein, 26 aa, Plasmodium falciparum
NNAIPNHFLPMYNMFNYPNAQYQNMQ

SEQ ID NO: 3390607 - protein, 24 aa, Plasmodium falciparum
NNALYIHGLYLQGASWFINSKNDT

SEQ ID NO: 3390608 - protein, 23 aa, Plasmodium falciparum
NNANDHFYIYKQTQNNYNDINQE

SEQ ID NO: 3390609 - protein, 26 aa, Plasmodium falciparum
NNANKIIDMNLLYNKDIDTLNSNGSA

SEQ ID NO: 3390610 - protein, 33 aa, Plasmodium falciparum
NNAPFVLPQIPGIDIIHLCYYIPNLKQYYSSKI

SEQ ID NO: 3390611 - protein, 18 aa, Plasmodium falciparum
NNAYPSTLNYYKFPKSCC

SEQ ID NO: 3390612 - protein, 20 aa, Plasmodium falciparum
NNCDYVKFLIYEEKANVNIL

SEQ ID NO: 3390613 - protein, 28 aa, Plasmodium falciparum
NNCGYSVCRSCLLFYILNCVIKENEKKM

SEQ ID NO: 3390614 - protein, 17 aa, Plasmodium falciparum
NNCKHFISFQKLISIKV

SEQ ID NO: 3390615 - protein, 41 aa, Plasmodium falciparum
NNCKVINIYSCYAIWLCMNEIYPSWFDISIHPAQFETEIDA

SEQ ID NO: 3390616 - protein, 28 aa, Plasmodium falciparum
NNCNFPYNYLNYNTKIYGIPRSNLSSCV

SEQ ID NO: 3390617 - protein, 19 aa, Plasmodium falciparum
NNCNITGVGSFHNNKFNDG

SEQ ID NO: 3390618 - protein, 24 aa, Plasmodium falciparum
NNCNNYHLPCYYISLIEDDEECGK

SEQ ID NO: 3390619 - protein, 36 aa, Plasmodium falciparum
NNCPFQIEMYLTPKFYKITYKYFPFLKHCIFKLEDQ

SEQ ID NO: 3390620 - protein, 35 aa, Plasmodium falciparum
NNCVSLLNMPLYFKRYHFLLLDFIIETNNEKNVHE

SEQ ID NO: 3390621 - protein, 28 aa, Plasmodium falciparum
NNDDKKKFWRFPFGKKKETKDANEEGID

SEQ ID NO: 3390622 - protein, 25 aa, Plasmodium falciparum
NNDDNLNYFLYNKKFSNYHDDNFIN

SEQ ID NO: 3390623 - protein, 25 aa, Plasmodium falciparum
NNDEKKKFLLLKNKYDYINNQMDDL

SEQ ID NO: 3390624 - protein, 30 aa, Plasmodium falciparum
NNDESLKSFQFLNGRYFGGSLINAYFISND

SEQ ID NO: 3390625 - protein, 26 aa, Plasmodium falciparum
NNDFKITQYFLFHKNSFERGVTEVLV

SEQ ID NO: 3390626 - protein, 19 aa, Plasmodium falciparum
NNDFLFSNLLNLWNDEHMN

SEQ ID NO: 3390627 - protein, 17 aa, Plasmodium falciparum
NNDILFHANNKKVIFFK

SEQ ID NO: 3390628 - protein, 17 aa, Plasmodium falciparum
NNDIYLKNLPTNKNYQV

SEQ ID NO: 3390629 - protein, 24 aa, Plasmodium falciparum
NNDKINLHIYLDDIYYRSGDIFRC

SEQ ID NO: 3390630 - protein, 24 aa, Plasmodium falciparum
NNDKQYFFITPHIEITELFLDDAK

SEQ ID NO: 3390631 - protein, 26 aa, Plasmodium falciparum
NNDLFQFLQCINKLFELYQRLNITKS

SEQ ID NO: 3390632 - protein, 18 aa, Plasmodium falciparum
NNDLKIKIKNFKTLLNDA

SEQ ID NO: 3390633 - protein, 18 aa, Plasmodium falciparum
NNDLLKRSDKFNKLVDSN

SEQ ID NO: 3390634 - protein, 19 aa, Plasmodium falciparum
NNDLYIWGNREILGMEYDD

SEQ ID NO: 3390635 - protein, 24 aa, Plasmodium falciparum
NNDMFKQPLLFNKPNMMNMHAYHM

SEQ ID NO: 3390636 - protein, 29 aa, Plasmodium falciparum
NNDMLIAHYFFFYLCGSYIKESKLKLGKI

SEQ ID NO: 3390637 - protein, 24 aa, Plasmodium falciparum
NNDNIYFRYFFHELCQTKKNDKKV

SEQ ID NO: 3390638 - protein, 25 aa, Plasmodium falciparum
NNDNKHIFFFAFDKIINTFNEKYLY

SEQ ID NO: 3390639 - protein, 23 aa, Plasmodium falciparum
NNDNKMWLFDEKRNYAKYVLKII

SEQ ID NO: 3390640 - protein, 22 aa, Plasmodium falciparum
NNDNMYYHIWNKNYDKDKYNIQ

SEQ ID NO: 3390641 - protein, 23 aa, Plasmodium falciparum
NNDNNYCYYYKSIDKNVSYYNSR

SEQ ID NO: 3390642 - protein, 23 aa, Plasmodium falciparum
NNDNSFILFNESFINILNKNQII

SEQ ID NO: 3390643 - protein, 25 aa, Plasmodium falciparum
NNDSFMKYIKGFLENNYINDQKNYL

SEQ ID NO: 3390644 - protein, 27 aa, Plasmodium falciparum
NNDVLQLPSVLHNHIRIVRTNDSCFKD

SEQ ID NO: 3390645 - protein, 24 aa, Plasmodium falciparum
NNDYIENWDLFLVIEKCDCSLNDI

SEQ ID NO: 3390646 - protein, 24 aa, Plasmodium falciparum
NNDYLLIKYSLVLLNLMDTYNIID

SEQ ID NO: 3390647 - protein, 25 aa, Plasmodium falciparum
NNEDDLFLTYFLIKHLYTYTENLLK

SEQ ID NO: 3390648 - protein, 25 aa, Plasmodium falciparum
NNEECKIFFSKKRAPYLLMFEVADL

SEQ ID NO: 3390649 - protein, 17 aa, Plasmodium falciparum
NNEFSIRVLFYKIKIIA

SEQ ID NO: 3390650 - protein, 24 aa, Plasmodium falciparum
NNEGCPFSYMNIKSLSTHNDNRNY

SEQ ID NO: 3390651 - protein, 27 aa, Plasmodium falciparum
NNEIKNYLETFPLPKITYLSNDNSIIQ

SEQ ID NO: 3390652 - protein, 34 aa, Plasmodium falciparum
NNEILTKLNQLEYKFYYDYLKNKSIENIYNSNSN

SEQ ID NO: 3390653 - protein, 31 aa, Plasmodium falciparum; identical to SEQ ID NO: 3368496

SEQ ID NO: 3390654 - protein, 20 aa, Plasmodium falciparum
NNELVLCRFCQKYDYKIQWI

SEQ ID NO: 3390655 - protein, 23 aa, Plasmodium falciparum
NNENIFLKNFFLSSKKYDNIENN

SEQ ID NO: 3390656 - protein, 25 aa, Plasmodium falciparum
NNENKKFFFLNNINNYHSKDIMDNY

SEQ ID NO: 3390657 - protein, 30 aa, Plasmodium falciparum
NNENKTFYNTLLLSYRGIISLIKQETPEIF

SEQ ID NO: 3390658 - protein, 27 aa, Plasmodium falciparum
NNENNIISFKPLSFNNKVTFMALENYN

SEQ ID NO: 3390659 - protein, 28 aa, Plasmodium falciparum
NNENNLLLYEKYIINNISKPLDLDQKKW

SEQ ID NO: 3390660 - protein, 34 aa, Plasmodium falciparum
NNEPQKILHIHDKSYYLIGKEQLAVDIQLNNISI

SEQ ID NO: 3390661 - protein, 27 aa, Plasmodium falciparum
NNESYPLINPKHNFFKSLLINGDKNML

SEQ ID NO: 3390662 - protein, 26 aa, Plasmodium falciparum
NNEYKYRFYYIFLNNYLTIQTMFTSN

SEQ ID NO: 3390663 - protein, 17 aa, Plasmodium falciparum
NNEYTINSRYPICQNYS

SEQ ID NO: 3390664 - protein, 30 aa, Plasmodium falciparum
NNFDDKFTLYLHILKKFPYLFDLNISDMNN

SEQ ID NO: 3390665 - protein, 28 aa, Plasmodium falciparum
NNFDKINMCPLIISYNRSIPTPKVVTIK

SEQ ID NO: 3390666 - protein, 25 aa, Plasmodium falciparum
NNFDNLIKHLNEIIKLILCEDSKKK

SEQ ID NO: 3390667 - protein, 17 aa, Plasmodium falciparum
NNFDYINKINYSVNIEL

SEQ ID NO: 3390668 - protein, 20 aa, Plasmodium falciparum
NNFGPFVPNFLKVPYDDLEA

SEQ ID NO: 3390669 - protein, 23 aa, Plasmodium falciparum
NNFKNIVFPLLGSGISLFKKHDV

SEQ ID NO: 3390670 - protein, 20 aa, Plasmodium falciparum
NNFKYVIGQNLHRDDNNILV

SEQ ID NO: 3390671 - protein, 34 aa, Plasmodium falciparum
NNFLRIYSTYGYIINTILLKGLPVAICAYDYLLF

SEQ ID NO: 3390672 - protein, 21 aa, Plasmodium falciparum
NNFNNNLAFLNSHCILTDKDF

SEQ ID NO: 3390673 - protein, 30 aa, Plasmodium falciparum
NNFNQNYIKELLIQKMYYQKEFYNNNDFIH

SEQ ID NO: 3390674 - protein, 24 aa, Plasmodium falciparum
NNFQSFFNLIKRKSNLKCDRKIVN

SEQ ID NO: 3390675 - protein, 17 aa, Plasmodium falciparum
NNFVTYCFTKYYALKLS

SEQ ID NO: 3390676 - protein, 22 aa, Plasmodium falciparum
NNFWKEQLFEICNMSPEDLKIH

SEQ ID NO: 3390677 - protein, 23 aa, Plasmodium falciparum
NNGDLIIKFSLKIPEKLTPRQVE

SEQ ID NO: 3390678 - protein, 22 aa, Plasmodium falciparum
NNGFYIVKYFSFLNDKQMKVKM

SEQ ID NO: 3390679 - protein, 23 aa, Plasmodium falciparum
NNGITKFFLKDLIKESSLKNNED

SEQ ID NO: 3390680 - protein, 24 aa, Plasmodium falciparum
NNGKMNIMTLLDTLNIREKNDNFL

SEQ ID NO: 3390681 - protein, 23 aa, Plasmodium falciparum
NNGRMEKPRYKPPMLRNQGNFNN

SEQ ID NO: 3390682 - protein, 26 aa, Plasmodium falciparum
NNHANNIIMNNMNIGFLKNNINDDKA

SEQ ID NO: 3390683 - protein, 24 aa, Plasmodium falciparum
NNHAYIIHLLTILDFNSYITKIKD

SEQ ID NO: 3390684 - protein, 27 aa, Plasmodium falciparum
NNHKKKIKLIDYNKILNKSLYDNVENV

SEQ ID NO: 3390685 - protein, 21 aa, Plasmodium falciparum
NNHLISLLCTDLENAHNIMTH

SEQ ID NO: 3390686 - protein, 25 aa, Plasmodium falciparum
NNHMKNNILCKETYLNCSGKKDTYK

SEQ ID NO: 3390687 - protein, 27 aa, Plasmodium falciparum
NNHNTSILYKVFYKRIMKGNSNDSIFD

SEQ ID NO: 3390688 - protein, 24 aa, Plasmodium falciparum
NNHPLLHTCFFKNAEDFENNDIKR

SEQ ID NO: 3390689 - protein, 23 aa, Plasmodium falciparum
NNHPNPYSFLNNSTHLSLYNDDK

SEQ ID NO: 3390690 - protein, 24 aa, Plasmodium falciparum
NNHQKNYISYYNNSFKYPSRSHIF

SEQ ID NO: 3390691 - protein, 20 aa, Plasmodium falciparum
NNICFSPIDTNLLLSSGKDV

SEQ ID NO: 3390692 - protein, 25 aa, Plasmodium falciparum
NNIDKLKCHNLIRNKNSNLVNFDRN

SEQ ID NO: 3390693 - protein, 24 aa, Plasmodium falciparum
NNIDSCYIYIQKYKIFITDYFAEQ

SEQ ID NO: 3390694 - protein, 24 aa, Plasmodium falciparum
NNIEDLNIFLASQLLCLEEKEDTF

SEQ ID NO: 3390695 - protein, 17 aa, Plasmodium falciparum
NNIELLYSYYLIVQNEA

SEQ ID NO: 3390696 - protein, 22 aa, Plasmodium falciparum
NNIELNMLKLYDTFKLEELKYN

SEQ ID NO: 3390697 - protein, 27 aa, Plasmodium falciparum
NNIFNETYYIEFFKKITKKKKKHSSIY

SEQ ID NO: 3390698 - protein, 20 aa, Plasmodium falciparum
NNIFRLYNRNNNSNYRIFQN

SEQ ID NO: 3390699 - protein, 36 aa, Plasmodium falciparum
NNIGNDNILKPFGKDWDFVINFDFDELFNQCENVIE

SEQ ID NO: 3390700 - protein, 25 aa, Plasmodium falciparum
NNIHKIIYIFDYQNIFTFYNVQDFI

SEQ ID NO: 3390701 - protein, 25 aa, Plasmodium falciparum
NNIHNMLHFFTSISKVYYCEVVNKK

SEQ ID NO: 3390702 - protein, 21 aa, Plasmodium falciparum
NNIIPVLYLDENMYIHFTVFL

SEQ ID NO: 3390703 - protein, 28 aa, Plasmodium falciparum
NNIISHNMKNIMYPYINNNITETTNTFI

SEQ ID NO: 3390704 - protein, 26 aa, Plasmodium falciparum
NNIISMGFNIPKPIYSLLQIKNLIDN

SEQ ID NO: 3390705 - protein, 17 aa, Plasmodium falciparum
NNIKFLLVLDRIRYAYN

SEQ ID NO: 3390706 - protein, 33 aa, Plasmodium falciparum
NNIKKQIPHIKYKFKRYIDTPPEKKKVATKKIS

SEQ ID NO: 3390707 - protein, 49 aa, Plasmodium falciparum
NNIKNTYPMNTNFNKNLFYGFGYNKCEYIPIIYDYHICYNKKENLSLKN

SEQ ID NO: 3390708 - protein, 23 aa, Plasmodium falciparum
NNIKTLIIPLNQKVLEISKKLNN

SEQ ID NO: 3390709 - protein, 17 aa, Plasmodium falciparum
NNILKRHKVDQTHLNGY

SEQ ID NO: 3390710 - protein, 29 aa, Plasmodium falciparum
NNILNMRYLFSLYEYIRLYLSKCNREKVQ

SEQ ID NO: 3390711 - protein, 24 aa, Plasmodium falciparum
NNIMNNTLYPWKENKFKNVDMLNI

SEQ ID NO: 3390712 - protein, 30 aa, Plasmodium falciparum
NNINCSYKDTFPYYLSMNDKKNRAYTENDN

SEQ ID NO: 3390713 - protein, 29 aa, Plasmodium falciparum
NNINDLVHLYFLPNIIFLDVSYNMLKEIV

SEQ ID NO: 3390714 - protein, 26 aa, Plasmodium falciparum
NNINDSIFLFDQLKNYIILENRKIFF

SEQ ID NO: 3390715 - protein, 24 aa, Plasmodium falciparum
NNINILNKIYININEKIKDLLQQI

SEQ ID NO: 3390716 - protein, 27 aa, Plasmodium falciparum
NNIPLTPPLPILPNFLNIPFIDNDLMA

SEQ ID NO: 3390717 - protein, 37 aa, Plasmodium falciparum
NNIPYLRNDILLKAYIYDNILLFTNFVEDDNKYFLKC

SEQ ID NO: 3390718 - protein, 25 aa, Plasmodium falciparum
NNISALYIPPLLYDNNVLSLCVNKE

SEQ ID NO: 3390719 - protein, 20 aa, Plasmodium falciparum
NNISLDTFNYLYKKYNEDTC

SEQ ID NO: 3390720 - protein, 27 aa, Plasmodium falciparum
NNISSMHFLYLLIYSKCKSIELTGVCV

SEQ ID NO: 3390721 - protein, 45 aa, Plasmodium falciparum
NNISYMEKINMLFKILYNHSLNISTCKIFFKYRFSKSEQEDHLFN

SEQ ID NO: 3390722 - protein, 29 aa, Plasmodium falciparum
NNIYDICSTYYNYLYTYDPNNSTYILQTS

SEQ ID NO: 3390723 - protein, 24 aa, Plasmodium falciparum
NNIYKWIDSYYKYDSKEELDILSP

SEQ ID NO: 3390724 - protein, 18 aa, Plasmodium falciparum
NNIYNKPTSLTYINDNKN

SEQ ID NO: 3390725 - protein, 24 aa, Plasmodium falciparum
NNIYQKVLIIFGQTLREISIYIFQ

SEQ ID NO: 3390726 - protein, 25 aa, Plasmodium falciparum
NNIYSLPNFLIIDNLSNYNPIGTEN

SEQ ID NO: 3390727 - protein, 17 aa, Plasmodium falciparum
NNIYSNGYINNCINRYA

SEQ ID NO: 3390728 - protein, 17 aa, Plasmodium falciparum
NNKDKLNILVNSISKLV

SEQ ID NO: 3390729 - protein, 41 aa, Plasmodium falciparum
NNKEKYLYFLKYFYCIYKDNNYIMPFLNKGKILIYRKSNFQ

SEQ ID NO: 3390730 - protein, 21 aa, Plasmodium falciparum
NNKESFIRRITQIRRSMINEK

SEQ ID NO: 3390731 - protein, 24 aa, Plasmodium falciparum
NNKFNENNILYKGTNYNRNVKNLG

SEQ ID NO: 3390732 - protein, 22 aa, Plasmodium falciparum
NNKHFMKSIPNYIFKKDIEEEI

SEQ ID NO: 3390733 - protein, 22 aa, Plasmodium falciparum
NNKHMNNFGNNQLPYIQHMNNN

SEQ ID NO: 3390734 - protein, 23 aa, Plasmodium falciparum
NNKIELLMCKLLHCVLNNFISIF

SEQ ID NO: 3390735 - protein, 22 aa, Plasmodium falciparum
NNKIGAHNLLYNMSGKHNNNTC

SEQ ID NO: 3390736 - protein, 21 aa, Plasmodium falciparum
NNKIILFMKGTKTFPQCKFSN

SEQ ID NO: 3390737 - protein, 22 aa, Plasmodium falciparum
NNKIKGFRNINIRIIKKEDEQE

SEQ ID NO: 3390738 - protein, 35 aa, Plasmodium falciparum
NNKILDYYVFSLISYIPLKLFPLSKEILYDTKPIV

SEQ ID NO: 3390739 - protein, 30 aa, Plasmodium falciparum
NNKINFLNLDLYLIHIFPNLLILNNSCVER

SEQ ID NO: 3390740 - protein, 27 aa, Plasmodium falciparum
NNKKCKKIFYIYFVEGNVQEFIQDINE

SEQ ID NO: 3390741 - protein, 26 aa, Plasmodium falciparum
NNKKDNIPLILLQQIKEKQNSLSDSS

SEQ ID NO: 3390742 - protein, 20 aa, Plasmodium falciparum
NNKKELSMKIQNKGFKKYSE

SEQ ID NO: 3390743 - protein, 24 aa, Plasmodium falciparum
NNKKGRIYKKYKPRIFTKTKEIIE

SEQ ID NO: 3390744 - protein, 25 aa, Plasmodium falciparum
NNKKKLHSFFIRNKLIYNNNNNSNN

SEQ ID NO: 3390745 - protein, 21 aa, Plasmodium falciparum
NNKKLLSSRLLKLNTKSNTSA

SEQ ID NO: 3390746 - protein, 22 aa, Plasmodium falciparum
NNKKLQILILSNNYIKHMEDII

SEQ ID NO: 3390747 - protein, 32 aa, Plasmodium falciparum
NNKKNIKLNNPKKSFLKGGVLLNRSDSFIKKG

SEQ ID NO: 3390748 - protein, 17 aa, Plasmodium falciparum
NNKLAFEEPFQLLFLMG

SEQ ID NO: 3390749 - protein, 23 aa, Plasmodium falciparum
NNKLKIELKKFWDLKEKKKKYEQ

SEQ ID NO: 3390750 - protein, 21 aa, Plasmodium falciparum
NNKLMYIPNDVLNKSAQQQYN

SEQ ID NO: 3390751 - protein, 17 aa, Plasmodium falciparum
NNKLRSFSIFPNDNEQI

SEQ ID NO: 3390752 - protein, 22 aa, Plasmodium falciparum
NNKLTWPLIKAFELCSQPEKED

SEQ ID NO: 3390753 - protein, 22 aa, Plasmodium falciparum
NNKMVTSCDLLNILSTKNDIND

SEQ ID NO: 3390754 - protein, 34 aa, Plasmodium falciparum
NNKNDKGVLLNLFGKPYSLRQRKQKIESVEDLAK

SEQ ID NO: 3390755 - protein, 29 aa, Plasmodium falciparum
NNKNDYDLLYASIFYRFLKRLPCKEEENI

SEQ ID NO: 3390756 - protein, 35 aa, Plasmodium falciparum
NNKNELQHLPKPLSVFYLPLCKLDLENDSVKYRLG

SEQ ID NO: 3390757 - protein, 26 aa, Plasmodium falciparum
NNKNETFSRFLFPKNPRAFTNLVEYS

SEQ ID NO: 3390758 - protein, 24 aa, Plasmodium falciparum
NNKNKGYIITDYSKGYISYDQTNS

SEQ ID NO: 3390759 - protein, 20 aa, Plasmodium falciparum
NNKNLLLTESDLRKFEYIHN

SEQ ID NO: 3390760 - protein, 23 aa, Plasmodium falciparum
NNKNYYLDYIKRLTQNNNNNENL

SEQ ID NO: 3390761 - protein, 25 aa, Plasmodium falciparum
NNKPARIKLYLCDHLRTCAKHVFNR

SEQ ID NO: 3390762 - protein, 23 aa, Plasmodium falciparum
NNKPLLPGHILLTTLKKKKHYND

SEQ ID NO: 3390763 - protein, 24 aa, Plasmodium falciparum
NNKQSKWIMEDKILQIKKSATHDN

SEQ ID NO: 3390764 - protein, 21 aa, Plasmodium falciparum
NNKRISIYYPFYIINDDKNNK

SEQ ID NO: 3390765 - protein, 33 aa, Plasmodium falciparum
NNKSDYFYQFDFLKKFKIDGIISFLFDDTYLEQ

SEQ ID NO: 3390766 - protein, 26 aa, Plasmodium falciparum
NNKTIKYIILMYEIIIKNMKKKCGMC

SEQ ID NO: 3390767 - protein, 24 aa, Plasmodium falciparum
NNKVGIPPHHLLDNTSLIKDEMNY

SEQ ID NO: 3390768 - protein, 25 aa, Plasmodium falciparum
NNKVMYLKNKPIQSKLLKLNNQILN

SEQ ID NO: 3390769 - protein, 36 aa, Plasmodium falciparum
NNKWERYYCFIKANIFYIYKLRGDYKPHVIFLLEGN

SEQ ID NO: 3390770 - protein, 17 aa, Plasmodium falciparum
NNKYILMIHEDSGSLVF

SEQ ID NO: 3390771 - protein, 30 aa, Plasmodium falciparum
NNKYIQLNFNYPFFYLLNVIKRYHINIKKF

SEQ ID NO: 3390772 - protein, 21 aa, Plasmodium falciparum
NNKYYECYSCKTQNLFANVQC

SEQ ID NO: 3390773 - protein, 26 aa, Plasmodium falciparum
NNLCRDQNKMYLLNQYNMRYNQNINQ

SEQ ID NO: 3390774 - protein, 28 aa, Plasmodium falciparum
NNLDNIFIGIVCYNPQIVDKRSALSFAG

SEQ ID NO: 3390775 - protein, 24 aa, Plasmodium falciparum
NNLEHFICIIGFSSTECYGYFFKK

SEQ ID NO: 3390776 - protein, 22 aa, Plasmodium falciparum
NNLFAYNIVKNCSAELCLKIIS

SEQ ID NO: 3390777 - protein, 26 aa, Plasmodium falciparum
NNLIKLCRTIFFTNIIPPLVKNDTKR

SEQ ID NO: 3390778 - protein, 18 aa, Plasmodium falciparum
NNLILENALLRNELPIYQ

SEQ ID NO: 3390779 - protein, 26 aa, Plasmodium falciparum
NNLKELWSLLNFLMPKIFDNSEEFDN

SEQ ID NO: 3390780 - protein, 27 aa, Plasmodium falciparum
NNLKENLKYSFNKFNSFNDMCINDISK

SEQ ID NO: 3390781 - protein, 22 aa, Plasmodium falciparum
NNLKGLFTGEKKTCMKSYLVNC

SEQ ID NO: 3390782 - protein, 24 aa, Plasmodium falciparum
NNLKQGLGIYKWDDGRIYFGNWLN

SEQ ID NO: 3390783 - protein, 22 aa, Plasmodium falciparum
NNLKYRGLFHILQHMKKNEISK

SEQ ID NO: 3390784 - protein, 25 aa, Plasmodium falciparum
NNLLGKFHLDGIPPAPRKVPQIEVT

SEQ ID NO: 3390785 - protein, 21 aa, Plasmodium falciparum
NNLLGKFQLEGIPPAPRSVPQ

SEQ ID NO: 3390786 - protein, 19 aa, Plasmodium falciparum
NNLLHFIASPNFNSVNNYF

SEQ ID NO: 3390787 - protein, 17 aa, Plasmodium falciparum
NNLLTIDKKYNACVDVT

SEQ ID NO: 3390788 - protein, 37 aa, Plasmodium falciparum
NNLNDLMNNSFLSNSLFPLLNKLQLPQTNKNVSNNKN

SEQ ID NO: 3390789 - protein, 23 aa, Plasmodium falciparum
NNLNGEFSKRILYNRSKSTENIK

SEQ ID NO: 3390790 - protein, 26 aa, Plasmodium falciparum
NNLNIAKFFYYILNFNMEDINNGGAN

SEQ ID NO: 3390791 - protein, 23 aa, Plasmodium falciparum
NNLNIIIRLLLNYITKKYTCLHK

SEQ ID NO: 3390792 - protein, 24 aa, Plasmodium falciparum
NNLNISTGKRRDLYKNDLINILNE

SEQ ID NO: 3390793 - protein, 28 aa, Plasmodium falciparum
NNLNNEYMFKYFNNYLNKSGKNNICDIN

SEQ ID NO: 3390794 - protein, 25 aa, Plasmodium falciparum
NNLQKNRKMLLPNNLKNSKVKQYLK

SEQ ID NO: 3390795 - protein, 21 aa, Plasmodium falciparum
NNLRALWGIVLVNLSRYGNKK

SEQ ID NO: 3390796 - protein, 25 aa, Plasmodium falciparum
NNLSRSYIYLIKRINLFSENNNEVD

SEQ ID NO: 3390797 - protein, 50 aa, Plasmodium falciparum
NNLYDNKLNIFLNFNKNHITKDIIFFCFSLCIFSYICGFKSTGKVKYLDF

SEQ ID NO: 3390798 - protein, 25 aa, Plasmodium falciparum
NNLYMNKNLFYYLASNVLKYDEESL

SEQ ID NO: 3390799 - protein, 19 aa, Plasmodium falciparum
NNMALIIMTFIYNDQIMNS

SEQ ID NO: 3390800 - protein, 19 aa, Plasmodium falciparum
NNMFKRFYNPRANINWTLI

SEQ ID NO: 3390801 - protein, 25 aa, Plasmodium falciparum
NNMGKKIINLFSLSNMFTCVKLPKD

SEQ ID NO: 3390802 - protein, 17 aa, Plasmodium falciparum
NNMNLSIGKIDLSNIYM

SEQ ID NO: 3390803 - protein, 24 aa, Plasmodium falciparum
NNMSGTKKLLWRDSDKTGSMSTWR

SEQ ID NO: 3390804 - protein, 17 aa, Plasmodium falciparum
NNMVLNRNSLSLNNMNL

SEQ ID NO: 3390805 - protein, 26 aa, Plasmodium falciparum
NNMYHDQNIPFLKNEYTYNNVLSKED

SEQ ID NO: 3390806 - protein, 17 aa, Plasmodium falciparum
NNMYLLKNKSLNRNGSI

SEQ ID NO: 3390807 - protein, 19 aa, Plasmodium falciparum
NNNAFPRNYTIPQTAWATR

SEQ ID NO: 3390808 - protein, 20 aa, Plasmodium falciparum
NNNCFYYNNNNNYYYHHCHN

SEQ ID NO: 3390809 - protein, 24 aa, Plasmodium falciparum
NNNCKYFNCLGFKFNMLNSDYNIL

SEQ ID NO: 3390810 - protein, 24 aa, Plasmodium falciparum
NNNDMNYRIIYRGRSLKDIDEIAK

SEQ ID NO: 3390811 - protein, 24 aa, Plasmodium falciparum
NNNDPSYIYLNKDNMIFDNINKYN

SEQ ID NO: 3390812 - protein, 34 aa, Plasmodium falciparum
NNNEIIFHNLLLNLKFFFPSLKNLNIKYTEVYQK

SEQ ID NO: 3390813 - protein, 33 aa, Plasmodium falciparum
NNNEIYIFSIKFFFLYYYIKIPVYEKVRNIFIN

SEQ ID NO: 3390814 - protein, 26 aa, Plasmodium falciparum
NNNEKCLLFLFHKRILKYLKCINDYT

SEQ ID NO: 3390815 - protein, 25 aa, Plasmodium falciparum
NNNEKDFLYFIEKYNIEKLTNDEKK

SEQ ID NO: 3390816 - protein, 25 aa, Plasmodium falciparum
NNNEKLIQDPFFQNEFVQGIDNYIN

SEQ ID NO: 3390817 - protein, 20 aa, Plasmodium falciparum
NNNFLDMNFLEQDQLFLENI

SEQ ID NO: 3390818 - protein, 27 aa, Plasmodium falciparum
NNNFNLFNNFFFNTFKHFGYSTKIQNN

SEQ ID NO: 3390819 - protein, 23 aa, Plasmodium falciparum
NNNHLKVLLWEKIWDYYRGLIIK

SEQ ID NO: 3390820 - protein, 22 aa, Plasmodium falciparum
NNNIFELKKLNLFAERKKKGDK

SEQ ID NO: 3390821 - protein, 27 aa, Plasmodium falciparum
NNNIFYYNNLTKHSQWHKPVHPNKLFQ

SEQ ID NO: 3390822 - protein, 20 aa, Plasmodium falciparum
NNNIINDNLLCLIKKGHDNA

SEQ ID NO: 3390823 - protein, 23 aa, Plasmodium falciparum
NNNIKLYGLDSFHKPDLIKNKNV

SEQ ID NO: 3390824 - protein, 23 aa, Plasmodium falciparum
NNNIPYPLVSRNDKYAPCIFSKE

SEQ ID NO: 3390825 - protein, 29 aa, Plasmodium falciparum
NNNIVHYVDWINQIFKKNSLQCDLYFLDD

SEQ ID NO: 3390826 - protein, 19 aa, Plasmodium falciparum
NNNIYFYEPCEKDNYLDSS

SEQ ID NO: 3390827 - protein, 29 aa, Plasmodium falciparum
NNNKDIINLLYPFTKRDGYKKFFLYDMGV

SEQ ID NO: 3390828 - protein, 43 aa, Plasmodium falciparum
NNNKGMNLDLFLYITKQYKILKNLLTKGELEQIFIKESKGNTS

SEQ ID NO: 3390829 - protein, 25 aa, Plasmodium falciparum
NNNKILNRYDLPKDISYYVEEYQKR

SEQ ID NO: 3390830 - protein, 31 aa, Plasmodium falciparum
NNNLDIFNIFFIMNIFKYSLKYKKLAIILAT

SEQ ID NO: 3390831 - protein, 22 aa, Plasmodium falciparum
NNNLYFLAFSKNKVTIYEYDVD

SEQ ID NO: 3390832 - protein, 18 aa, Plasmodium falciparum
NNNMKQNYYMAPKNDMNN

SEQ ID NO: 3390833 - protein, 20 aa, Plasmodium falciparum
NNNMYSTYNSPPGLANQYNY

SEQ ID NO: 3390834 - protein, 23 aa, Plasmodium falciparum
NNNNCVFRVILSYGFKSMHNVLR

SEQ ID NO: 3390835 - protein, 24 aa, Plasmodium falciparum
NNNNDYFISYELRKLIESINIYQR

SEQ ID NO: 3390836 - protein, 29 aa, Plasmodium falciparum
NNNNHKMFYNYNKYNMYAPKIYYHDNMHN

SEQ ID NO: 3390837 - protein, 26 aa, Plasmodium falciparum
NNNNIIFYNEFIKDDNYYNNICLNNE

SEQ ID NO: 3390838 - protein, 28 aa, Plasmodium falciparum
NNNNIILYKSFDDFKINYSYKTKNHLHE

SEQ ID NO: 3390839 - protein, 25 aa, Plasmodium falciparum
NNNNINSEYLFDSCNKYLNVENNYD

SEQ ID NO: 3390840 - protein, 25 aa, Plasmodium falciparum
NNNNIVWKYLTDVFDYLPLTAIIND

SEQ ID NO: 3390841 - protein, 27 aa, Plasmodium falciparum
NNNNKCYYYLTDPFISTYPKNDMVKKE

SEQ ID NO: 3390842 - protein, 24 aa, Plasmodium falciparum
NNNNKLILFEYTKNDQMLHNNKNN

SEQ ID NO: 3390843 - protein, 25 aa, Plasmodium falciparum
NNNNLNVPLDIHKLRQHYLNILQNK

SEQ ID NO: 3390844 - protein, 24 aa, Plasmodium falciparum
NNNNLTMFNCDLASNPYKNDLTCS

SEQ ID NO: 3390845 - protein, 24 aa, Plasmodium falciparum
NNNNNFYYNYNYNYYINDNSYTNE

SEQ ID NO: 3390846 - protein, 25 aa, Plasmodium falciparum
NNNNNNDCFGRRPIHFFKHLNKHKV

SEQ ID NO: 3390847 - protein, 27 aa, Plasmodium falciparum
NNNNNNYYYYYYINNYNRSMQGQNNNN

SEQ ID NO: 3390848 - protein, 25 aa, Plasmodium falciparum
NNNNNYFCIPCGYNTKEYKYNIYNT

SEQ ID NO: 3390849 - protein, 25 aa, Plasmodium falciparum
NNNNNYVYNFSLDKQLFEALNNHNE

SEQ ID NO: 3390850 - protein, 26 aa, Plasmodium falciparum
NNNNNYYYYHKDNFKIFSGPATDKEI

SEQ ID NO: 3390851 - protein, 26 aa, Plasmodium falciparum
NNNNNYYYYNIPKNLERTKETIETCN

SEQ ID NO: 3390852 - protein, 25 aa, Plasmodium falciparum
NNNNNYYYYYINNDNIHLNNSHIDI

SEQ ID NO: 3390853 - protein, 30 aa, Plasmodium falciparum
NNNNSFFLPRLKPLMWCYEKEIVLYAFHLK

SEQ ID NO: 3390854 - protein, 26 aa, Plasmodium falciparum
NNNNYSFLFYHYISLSLLNIPEINEY

SEQ ID NO: 3390855 - protein, 17 aa, Plasmodium falciparum
NNNPYNYMINNNKLNYM

SEQ ID NO: 3390856 - protein, 24 aa, Plasmodium falciparum
NNNQKNNMIPLFNDDHIVNYRNIS

SEQ ID NO: 3390857 - protein, 26 aa, Plasmodium falciparum
NNNQNNYYLHYGFISDLYNRTHSHDN

SEQ ID NO: 3390858 - protein, 24 aa, Plasmodium falciparum
NNNSEYLIILKNFLIRINDINHNV

SEQ ID NO: 3390859 - protein, 32 aa, Plasmodium falciparum
NNNSIFLNENISYFSLFSFGEKYAIIKYNNEN

SEQ ID NO: 3390860 - protein, 20 aa, Plasmodium falciparum
NNNSLVKCLFFLPDEEYIDT

SEQ ID NO: 3390861 - protein, 30 aa, Plasmodium falciparum
NNNSMNNDLLNLLYLYELSQKNKNQNVPQI

SEQ ID NO: 3390862 - protein, 23 aa, Plasmodium falciparum
NNNTLVHKMVTNNPPKLSAQTYS

SEQ ID NO: 3390863 - protein, 25 aa, Plasmodium falciparum
NNNTQIFNYFNYVSNSNFNIQRYLS

SEQ ID NO: 3390864 - protein, 18 aa, Plasmodium falciparum
NNNVILNPNYDMISRNEN

SEQ ID NO: 3390865 - protein, 18 aa, Plasmodium falciparum
NNNYLSEHLLLNQKQNNT

SEQ ID NO: 3390866 - protein, 24 aa, Plasmodium falciparum
NNNYMPPNGIISNNIYPSNNFSNR

SEQ ID NO: 3390867 - protein, 23 aa, Plasmodium falciparum
NNNYNNTYYCYYKNMKHGSNYEG

SEQ ID NO: 3390868 - protein, 21 aa, Plasmodium falciparum
NNNYSLGLYIDNPQKAFLFDE

SEQ ID NO: 3390869 - protein, 20 aa, Plasmodium falciparum
NNNYTFLKTQPRNSLSIDNS

SEQ ID NO: 3390870 - protein, 20 aa, Plasmodium falciparum
NNNYYYYNNFGKIHNVDNTN

SEQ ID NO: 3390871 - protein, 20 aa, Plasmodium falciparum
NNNYYYYQHNNNLSHITVLE

SEQ ID NO: 3390872 - protein, 25 aa, Plasmodium falciparum
NNPINYQMNIPLDYQMIPNNNINNI

SEQ ID NO: 3390873 - protein, 23 aa, Plasmodium falciparum
NNPSEEINILNNYIKNITNAYQN

SEQ ID NO: 3390874 - protein, 36 aa, Plasmodium falciparum
NNPSLSILIILFDELLLYETINFLLLNNIPNDKFSL

SEQ ID NO: 3390875 - protein, 23 aa, Plasmodium falciparum
NNPYKIIDTLFNILVKFAKADII

SEQ ID NO: 3390876 - protein, 28 aa, Plasmodium falciparum
NNQALPMFLVKLYSYQLCRALSYIHSKF

SEQ ID NO: 3390877 - protein, 24 aa, Plasmodium falciparum
NNQDNNFIPLPHNKSYNNIVSSNN

SEQ ID NO: 3390878 - protein, 17 aa, Plasmodium falciparum
NNQFIYYPKVPLHQIQA

SEQ ID NO: 3390879 - protein, 18 aa, Plasmodium falciparum
NNQIIYDKFLQKDISQNE

SEQ ID NO: 3390880 - protein, 34 aa, Plasmodium falciparum
NNQIKITILNTNKLKKHILSSRVIIYSKGASLVY

SEQ ID NO: 3390881 - protein, 25 aa, Plasmodium falciparum
NNQILTNQIILFKKNIKKVDEEKKE

SEQ ID NO: 3390882 - protein, 23 aa, Plasmodium falciparum
NNQLVYDWVPVFDMQILNDLENK

SEQ ID NO: 3390883 - protein, 22 aa, Plasmodium falciparum
NNQLVYIKPPTNVEEKNLLINF

SEQ ID NO: 3390884 - protein, 22 aa, Plasmodium falciparum
NNQNIYLPPKNIKHRIYSTNQE

SEQ ID NO: 3390885 - protein, 24 aa, Plasmodium falciparum
NNQSLYILKNIFLKDLYKQQKIYQ

SEQ ID NO: 3390886 - protein, 17 aa, Plasmodium falciparum
NNQVHNFFLISKQIRNI

SEQ ID NO: 3390887 - protein, 27 aa, Plasmodium falciparum
NNRENKIYFDLIQGNLYYISGVVIHYT

SEQ ID NO: 3390888 - protein, 35 aa, Plasmodium falciparum
NNREYNILLKYYNTKNLYNLIYFVGNISLSKNNII

SEQ ID NO: 3390889 - protein, 28 aa, Plasmodium falciparum
NNRFIHTYNMLFINIFYNIISKNRNEKK

SEQ ID NO: 3390890 - protein, 17 aa, Plasmodium falciparum
NNRFYFMSLQSCTANNI

SEQ ID NO: 3390891 - protein, 17 aa, Plasmodium falciparum
NNRYRLDKPLAQYFHIF

SEQ ID NO: 3390892 - protein, 27 aa, Plasmodium falciparum
NNSAELFTLINFMFPDIFKNSEIIEQA

SEQ ID NO: 3390893 - protein, 25 aa, Plasmodium falciparum
NNSDFIQYVFKWGIGNKFRSDPENR

SEQ ID NO: 3390894 - protein, 22 aa, Plasmodium falciparum
NNSDIIIREPFFKTSKYGKQNE

SEQ ID NO: 3390895 - protein, 27 aa, Plasmodium falciparum
NNSDMDNFWVIVKYLKNKSSILHEDDV

SEQ ID NO: 3390896 - protein, 19 aa, Plasmodium falciparum
NNSFPYNKKILKGKVFNAT

SEQ ID NO: 3390897 - protein, 28 aa, Plasmodium falciparum
NNSKYYRIKLCPFLKEGFCQKGDNCSYA

SEQ ID NO: 3390898 - protein, 22 aa, Plasmodium falciparum
NNSLFYINAIEECRKAERFDVS

SEQ ID NO: 3390899 - protein, 23 aa, Plasmodium falciparum
NNSLISCSNFWNCTEDELSTSAP

SEQ ID NO: 3390900 - protein, 25 aa, Plasmodium falciparum
NNSLKLICKIKYINNNYQLIPCIEN

SEQ ID NO: 3390901 - protein, 17 aa, Plasmodium falciparum
NNSLLYNKQYHLIKSNH

SEQ ID NO: 3390902 - protein, 34 aa, Plasmodium falciparum
NNSLSDLNYLLYNTNVLKKLKLNLLENKKGNNIN

SEQ ID NO: 3390903 - protein, 18 aa, Plasmodium falciparum
NNSMLYDNKGCIPYNPNH

SEQ ID NO: 3390904 - protein, 25 aa, Plasmodium falciparum
NNSNIVHMLIEENSFFKDNALSQKS

SEQ ID NO: 3390905 - protein, 27 aa, Plasmodium falciparum
NNSNNFYYFNIYNSKSIWEYSSHNIDY

SEQ ID NO: 3390906 - protein, 35 aa, Plasmodium falciparum
NNSNNMMYASNRSLINPYMNIMNMKGNVNMNNNMN

SEQ ID NO: 3390907 - protein, 25 aa, Plasmodium falciparum
NNSNRPVVRKVIKRVIRTRVKNKKD

SEQ ID NO: 3390908 - protein, 27 aa, Plasmodium falciparum
NNSRPPLYEDLFLKKTKITNIDDKNTK

SEQ ID NO: 3390909 - protein, 30 aa, Plasmodium falciparum
NNSSSYVTKKKLFHTYKNVSSYNKKKNTYI

SEQ ID NO: 3390910 - protein, 27 aa, Plasmodium falciparum
NNSSYMYSSQMYKYMKSNKYDTCMNTN

SEQ ID NO: 3390911 - protein, 26 aa, Plasmodium falciparum
NNSTIMCVSSLIRIYIKTIRIETSME

SEQ ID NO: 3390912 - protein, 18 aa, Plasmodium falciparum
NNSTNDLNLLYRSSNNNN

SEQ ID NO: 3390913 - protein, 25 aa, Plasmodium falciparum
NNSYNYMNYYYNYANNYINSYNYNP

SEQ ID NO: 3390914 - protein, 24 aa, Plasmodium falciparum
NNTFNNLYYMDENIITNNINVIPL

SEQ ID NO: 3390915 - protein, 17 aa, Plasmodium falciparum
NNTGLFGFYVQCDEIAV

SEQ ID NO: 3390916 - protein, 26 aa, Plasmodium falciparum
NNTINLMNYKILLNTKKKKEKKKKKN

SEQ ID NO: 3390917 - protein, 23 aa, Plasmodium falciparum
NNTNHWMFLKYNNMFKRFYNPRA

SEQ ID NO: 3390918 - protein, 19 aa, Plasmodium falciparum
NNTNKPLNPSLYVVSNMMN

SEQ ID NO: 3390919 - protein, 24 aa, Plasmodium falciparum
NNTQYNHNILPTNKDLLVFKTNQQ

SEQ ID NO: 3390920 - protein, 44 aa, Plasmodium falciparum
NNTSDKYILKYNIEYFKLAQFFSQDYHLFKNYIKHVDKKLSKNN

SEQ ID NO: 3390921 - protein, 29 aa, Plasmodium falciparum
NNTSNHFYNSLNMKLINYGNFGYNNNNHY

SEQ ID NO: 3390922 - protein, 29 aa, Plasmodium falciparum
NNTSPIINHPLKLPLLPEMSHPNVFSSHS

SEQ ID NO: 3390923 - protein, 24 aa, Plasmodium falciparum
NNTYEIIGLIYYGDKSQVYKCINM

SEQ ID NO: 3390924 - protein, 25 aa, Plasmodium falciparum
NNVEKNIMKMVYNKNIWASKEEEFL

SEQ ID NO: 3390925 - protein, 23 aa, Plasmodium falciparum
NNVKFNDIILKEKDKWLVELDNS

SEQ ID NO: 3390926 - protein, 30 aa, Plasmodium falciparum
NNVKPFYNYTFNFLFMDFSGSIILRAFSDE

SEQ ID NO: 3390927 - protein, 27 aa, Plasmodium falciparum
NNVKRMKIFFRYYMKNLFLGNFDKILD

SEQ ID NO: 3390928 - protein, 22 aa, Plasmodium falciparum
NNVKSRFYIKRICLKNNKTMEN

SEQ ID NO: 3390929 - protein, 25 aa, Plasmodium falciparum
NNVLLSFLIIDDKIIGLSLSKYTLN

SEQ ID NO: 3390930 - protein, 34 aa, Plasmodium falciparum
NNVNMMNQFPYGNNTEYILNNKLTFNNNDLNQDK

SEQ ID NO: 3390931 - protein, 18 aa, Plasmodium falciparum
NNVNTIVLFGFKTLFGGG

SEQ ID NO: 3390932 - protein, 19 aa, Plasmodium falciparum
NNVPNLPRNYSYDNMNRTW

SEQ ID NO: 3390933 - protein, 26 aa, Plasmodium falciparum
NNVQIKPYFFSPYLEKNYITYYVMNI

SEQ ID NO: 3390934 - protein, 19 aa, Plasmodium falciparum
NNVWYRLYASWKQGTSFSR

SEQ ID NO: 3390935 - protein, 22 aa, Plasmodium falciparum
NNVYSYLKNIPYTNRNNNCFIN

SEQ ID NO: 3390936 - protein, 18 aa, Plasmodium falciparum
NNWAMYGRPIVKRQNNRN

SEQ ID NO: 3390937 - protein, 22 aa, Plasmodium falciparum
NNWLEYVGFTVSCSDIIASNKV

SEQ ID NO: 3390938 - protein, 20 aa, Plasmodium falciparum
NNYDFVKYSSNLKDGDHSNM

SEQ ID NO: 3390939 - protein, 33 aa, Plasmodium falciparum
NNYDNYNFYNFLFNLLYINFYDLCSTFFDYIKK

SEQ ID NO: 3390940 - protein, 17 aa, Plasmodium falciparum
NNYEIQYKKKTLRDTNI

SEQ ID NO: 3390941 - protein, 21 aa, Plasmodium falciparum
NNYEPMNFKSFDDITMSEMDQ

SEQ ID NO: 3390942 - protein, 26 aa, Plasmodium falciparum
NNYFIKPYFEEPLKNEILDRVERMNL

SEQ ID NO: 3390943 - protein, 26 aa, Plasmodium falciparum
NNYGLKKKITLLKRNDIKDEGYNNEN

SEQ ID NO: 3390944 - protein, 21 aa, Plasmodium falciparum
NNYGSFAYGWNKPITFLNSSS

SEQ ID NO: 3390945 - protein, 25 aa, Plasmodium falciparum
NNYHMNDIEKCIPKPVLYTHNKYDV

SEQ ID NO: 3390946 - protein, 20 aa, Plasmodium falciparum
NNYIELIKNNSFCNDKYIIE

SEQ ID NO: 3390947 - protein, 23 aa, Plasmodium falciparum
NNYIPYIDPHLNNEPYKHTINNQ

SEQ ID NO: 3390948 - protein, 38 aa, Plasmodium falciparum
NNYISCLYCDKYLFKLDNYHEDFFFVCSNKEELRKEKY

SEQ ID NO: 3390949 - protein, 35 aa, Plasmodium falciparum
NNYISIKCPLDLIPLYILPPYQDLQYLDFIGNNKF

SEQ ID NO: 3390950 - protein, 23 aa, Plasmodium falciparum
NNYKIVIMLMEYCERGNLLNIFQ

SEQ ID NO: 3390951 - protein, 17 aa, Plasmodium falciparum
NNYLSFSHLYLSKFVKK

SEQ ID NO: 3390952 - protein, 32 aa, Plasmodium falciparum
NNYMNGTNNYFYENMYPAYENENYYYADNKFS

SEQ ID NO: 3390953 - protein, 23 aa, Plasmodium falciparum
NNYMRKPNIINVHRKKCSVDIMN

SEQ ID NO: 3390954 - protein, 27 aa, Plasmodium falciparum
NNYNINKMMVYPPQNIITHGNTTTNIT

SEQ ID NO: 3390955 - protein, 17 aa, Plasmodium falciparum
NNYNYIELFIYNVKNEE

SEQ ID NO: 3390956 - protein, 17 aa, Plasmodium falciparum
NNYNYLYHILSEISKYS

SEQ ID NO: 3390957 - protein, 81 aa, Plasmodium falciparum
NNYNYMAYHKMSCLNYVYPYNPYRNKNYPYGNLPNIYYPDGYYANYCYPNYYYPIYYYPNYYYPNNYYAYNNFPHNNFRHN

SEQ ID NO: 3390958 - protein, 27 aa, Plasmodium falciparum
NNYRTKTALFIFKYFDIYAEEKINDSS

SEQ ID NO: 3390959 - protein, 18 aa, Plasmodium falciparum
NNYSYIYKVRNSEQILPL

SEQ ID NO: 3390960 - protein, 17 aa, Plasmodium falciparum
NNYYDIFEEAYKNYINK

SEQ ID NO: 3390961 - protein, 20 aa, Plasmodium falciparum
NNYYIKIKKNKYKKLNDLLN

SEQ ID NO: 3390962 - protein, 24 aa, Plasmodium falciparum
NNYYLKCCIYYIKRLFMSIENFDN

SEQ ID NO: 3390963 - protein, 33 aa, Plasmodium falciparum
NNYYNEIIKMVVHFNNILLLMLNNNATEMKDKI

SEQ ID NO: 3390964 - protein, 28 aa, Plasmodium falciparum
NNYYNKNEFFRVIPRFLIQTGDHTNTGL

SEQ ID NO: 3390965 - protein, 17 aa, Plasmodium falciparum
NNYYYYKKKKKKRKDYH

SEQ ID NO: 3390966 - protein, 20 aa, Plasmodium falciparum
NPCLFFEPKILYRSSVCDVP

SEQ ID NO: 3390967 - protein, 23 aa, Plasmodium falciparum
NPCLQLWDLRNSNYPIKEIIGHS

SEQ ID NO: 3390968 - protein, 27 aa, Plasmodium falciparum
NPDEMKIFLILCKSKILFTYRSNFLIR

SEQ ID NO: 3390969 - protein, 21 aa, Plasmodium falciparum
NPEKLIITALLVPPNTIRPSV

SEQ ID NO: 3390970 - protein, 24 aa, Plasmodium falciparum
NPEKYPHLLSIKSCFVRGSVVRYV

SEQ ID NO: 3390971 - protein, 18 aa, Plasmodium falciparum
NPENITVGFLATILKMIS

SEQ ID NO: 3390972 - protein, 24 aa, Plasmodium falciparum
NPEWVVYHELLLTSKNFIRTVTKI

SEQ ID NO: 3390973 - protein, 27 aa, Plasmodium falciparum
NPFNLRNNLLNILDTSKLYPKCELICR

SEQ ID NO: 3390974 - protein, 25 aa, Plasmodium falciparum
NPFNYSWICIYPYNNHIKIIRQSDP

SEQ ID NO: 3390975 - protein, 27 aa, Plasmodium falciparum
NPGSDLYYLTGWIPVTISLKSKISSSP

SEQ ID NO: 3390976 - protein, 27 aa, Plasmodium falciparum
NPHNLYNNISLLCPPKMKGNSENLSTN

SEQ ID NO: 3390977 - protein, 20 aa, Plasmodium falciparum
NPHQCTMLNIPNIKLKRKTK

SEQ ID NO: 3390978 - protein, 38 aa, Plasmodium falciparum
NPIGKTVNIFYRWSRGPPRTVCFFHPQKIACLQCTVTF

SEQ ID NO: 3390979 - protein, 17 aa, Plasmodium falciparum
NPIVLYVSGSNTQIIYY

SEQ ID NO: 3390980 - protein, 17 aa, Plasmodium falciparum
NPKLIHFYEAYDSLPLL

SEQ ID NO: 3390981 - protein, 17 aa, Plasmodium falciparum
NPKTYGQYPKWSCIVGK

SEQ ID NO: 3390982 - protein, 32 aa, Plasmodium falciparum
NPLICIMNNFLYFLLLSEYLNFNELFKLMPLC

SEQ ID NO: 3390983 - protein, 27 aa, Plasmodium falciparum
NPLKESTLLNISFNCIDKRITNLQNYL

SEQ ID NO: 3390984 - protein, 27 aa, Plasmodium falciparum
NPLYQNRLEPQLLFGRGYIAGIDVREQ

SEQ ID NO: 3390985 - protein, 32 aa, Plasmodium falciparum
NPNRRNMQRIDIFNMILMRDMLSNLDENNVSF

SEQ ID NO: 3390986 - protein, 17 aa, Plasmodium falciparum
NPNYMTCPYINSYENCT

SEQ ID NO: 3390987 - protein, 23 aa, Plasmodium falciparum
NPPKPRYFAKLNLIYSTEKKEDC

SEQ ID NO: 3390988 - protein, 24 aa, Plasmodium falciparum
NPPRKGCGKVFRRWIRGLCCKHII

SEQ ID NO: 3390989 - protein, 17 aa, Plasmodium falciparum
NPPVVPQYDKICRHIFV

SEQ ID NO: 3390990 - protein, 33 aa, Plasmodium falciparum
NPSLVKRLLKDNVALVILLECIQQYSKIYDKSE

SEQ ID NO: 3390991 - protein, 26 aa, Plasmodium falciparum
NPSNINYFYFYILNQIDLCNKEEKNI

SEQ ID NO: 3390992 - protein, 33 aa, Plasmodium falciparum
NPSNISKFFLLKYFLYIFREDSSLLIYDIRYFK

SEQ ID NO: 3390993 - protein, 19 aa, Plasmodium falciparum
NPTLSSAILFLIVLMHKKH

SEQ ID NO: 3390994 - protein, 21 aa, Plasmodium falciparum
NPVFTFDYKIKNDIWYMYVTS

SEQ ID NO: 3390995 - protein, 17 aa, Plasmodium falciparum
NPYNYMINNNKLNYMQN

SEQ ID NO: 3390996 - protein, 24 aa, Plasmodium falciparum
NQCEKIFDLTKYQHKNMKKKISFD

SEQ ID NO: 3390997 - protein, 19 aa, Plasmodium falciparum
NQDLLLEYFKKFPSFDFNN

SEQ ID NO: 3390998 - protein, 29 aa, Plasmodium falciparum
NQEIYVSKLFITLLYKKYFSKKKQKCCSP

SEQ ID NO: 3390999 - protein, 20 aa, Plasmodium falciparum
NQERNKVTIFLTVKNVHTVG

SEQ ID NO: 3391000 - protein, 30 aa, Plasmodium falciparum
NQEVQKWLNLFPYDEYALYVIDILHEIQVR

SEQ ID NO: 3391001 - protein, 26 aa, Plasmodium falciparum
NQFMIKTFIQGFLTISLKRISQINTF

SEQ ID NO: 3391002 - protein, 25 aa, Plasmodium falciparum
NQFPRSYPEFFEANFGPIDELMDET

SEQ ID NO: 3391003 - protein, 27 aa, Plasmodium falciparum
NQHNPMYMPPGLYPPPIPPLNHPSIPP

SEQ ID NO: 3391004 - protein, 25 aa, Plasmodium falciparum
NQHTNNLIKFMNPKTIMSNKLISNF

SEQ ID NO: 3391005 - protein, 19 aa, Plasmodium falciparum
NQHYYYYNNPHILSNNNIN

SEQ ID NO: 3391006 - protein, 25 aa, Plasmodium falciparum
NQIEEHFYSTYISKDALIGAPTNDE

SEQ ID NO: 3391007 - protein, 46 aa, Plasmodium falciparum
NQINCYDVLLEIRKRVPRWGDYKCNFFFHWKKIMELNNEELKIYIL

SEQ ID NO: 3391008 - protein, 18 aa, Plasmodium falciparum
NQINMHIVEFDKIYQLYI

SEQ ID NO: 3391009 - protein, 18 aa, Plasmodium falciparum
NQINWNLNNLCTINNIYT

SEQ ID NO: 3391010 - protein, 24 aa, Plasmodium falciparum
NQIPNRRFTLWWSPTINRANVYVG

SEQ ID NO: 3391011 - protein, 23 aa, Plasmodium falciparum
NQIRCRSLSYKNRLQKLKLLKES

SEQ ID NO: 3391012 - protein, 23 aa, Plasmodium falciparum
NQIYTILINNYNLPRKYIVLNSK

SEQ ID NO: 3391013 - protein, 24 aa, Plasmodium falciparum
NQKELWVTLLEKAFVKLMGGSYSM

SEQ ID NO: 3391014 - protein, 24 aa, Plasmodium falciparum
NQKENIFHYITHLSKQIHSSHFYE

SEQ ID NO: 3391015 - protein, 41 aa, Plasmodium falciparum
NQKGKRSTGGVFFYLIKYMYKNDIISKFKYDYIIEEEKEKK

SEQ ID NO: 3391016 - protein, 25 aa, Plasmodium falciparum
NQKKTFFHFNLLEYNFTLMERTATH

SEQ ID NO: 3391017 - protein, 25 aa, Plasmodium falciparum
NQKLNIIYFLCKFHFYNETIKKFYL

SEQ ID NO: 3391018 - protein, 23 aa, Plasmodium falciparum
NQKLTACYLKLKEYALAIEAAKK

SEQ ID NO: 3391019 - protein, 22 aa, Plasmodium falciparum
NQKQLILKRSDITNMNFSNDSH

SEQ ID NO: 3391020 - protein, 22 aa, Plasmodium falciparum
NQKRFIQLLDDLNGDNLDTVNN

SEQ ID NO: 3391021 - protein, 33 aa, Plasmodium falciparum
NQKSKDRIVKIKRKIKKFIKLTKGELKLLSKVL

SEQ ID NO: 3391022 - protein, 22 aa, Plasmodium falciparum
NQKTFHFYEFPKIQVLSKLKED

SEQ ID NO: 3391023 - protein, 84 aa, Plasmodium falciparum
NQLKADKYTCMMRKLRGILNKLTFEKFDLLYEQIILVGITKLDEIIGLMKLVFEKAVTQHHFVQMYVQLCKKLNVHFHNMKLED

SEQ ID NO: 3391024 - protein, 22 aa, Plasmodium falciparum
NQLKDTLKSISSLSNKIVNYES

SEQ ID NO: 3391025 - protein, 19 aa, Plasmodium falciparum
NQMFPYADPNFCKNGRMRP

SEQ ID NO: 3391026 - protein, 22 aa, Plasmodium falciparum
NQNAVEIRKICLLALGCCMDIH

SEQ ID NO: 3391027 - protein, 29 aa, Plasmodium falciparum
NQNDYLLCTINEFLKQGLKNECIPLFQRL

SEQ ID NO: 3391028 - protein, 22 aa, Plasmodium falciparum
NQNIPNYYNYPNYHSYPNYDNY

SEQ ID NO: 3391029 - protein, 34 aa, Plasmodium falciparum
NQNKDLQKLFMYLMSWYFSGYYSGKMSVLKELYR

SEQ ID NO: 3391030 - protein, 28 aa, Plasmodium falciparum
NQNKLYYSGKLFLINNFTFLTLKIDSDV

SEQ ID NO: 3391031 - protein, 30 aa, Plasmodium falciparum
NQNMGLRQKGYYPLFGDIPKCKVQILPSQI

SEQ ID NO: 3391032 - protein, 33 aa, Plasmodium falciparum
NQNNFPKNHMFPLLPSSPFFQPPNFRTNLTQAS

SEQ ID NO: 3391033 - protein, 24 aa, Plasmodium falciparum
NQPMSLLIRKLKFDTSPSIVREKF

SEQ ID NO: 3391034 - protein, 19 aa, Plasmodium falciparum
NQQLIPQMNFVSGANIDMN

SEQ ID NO: 3391035 - protein, 23 aa, Plasmodium falciparum
NQRDFIFFRHYKYNFVDKKKCNL

SEQ ID NO: 3391036 - protein, 23 aa, Plasmodium falciparum
NQRKNYFYYIKKKLLEKYARIKH

SEQ ID NO: 3391037 - protein, 25 aa, Plasmodium falciparum
NQTDDNFYNVYLWNEIKKKDEPFQD

SEQ ID NO: 3391038 - protein, 24 aa, Plasmodium falciparum
NQTKDMKHILFSLNAADEFKKKKK

SEQ ID NO: 3391039 - protein, 30 aa, Plasmodium falciparum
NQTNIISDAIHLMPIYLKKNKMLPCNNDIM

SEQ ID NO: 3391040 - protein, 17 aa, Plasmodium falciparum
NQVFNNMHLLNNSNSSL

SEQ ID NO: 3391041 - protein, 19 aa, Plasmodium falciparum
NQVIIFVKSVTRAITLDKL

SEQ ID NO: 3391042 - protein, 20 aa, Plasmodium falciparum
NQVLKKVDVLLLLKANKKKR

SEQ ID NO: 3391043 - protein, 20 aa, Plasmodium falciparum
NQYFKDIFKNLRNNNLSTNT

SEQ ID NO: 3391044 - protein, 32 aa, Plasmodium falciparum
NRAPSTLFCCLYKFFTMQLSEKQLKSLIENKD

SEQ ID NO: 3391045 - protein, 20 aa, Plasmodium falciparum
NRCSLRKPHLLFPLLECHEE

SEQ ID NO: 3391046 - protein, 23 aa, Plasmodium falciparum
NRDFNVLAEFHLNLRKTLEHKDN

SEQ ID NO: 3391047 - protein, 19 aa, Plasmodium falciparum
NRDKLMMLFESVNNNDNCR

SEQ ID NO: 3391048 - protein, 24 aa, Plasmodium falciparum
NRDQKMNFIINKINKKLTYKQIYM

SEQ ID NO: 3391049 - protein, 20 aa, Plasmodium falciparum
NRDSFFHFFTSHKVPNSNVI

SEQ ID NO: 3391050 - protein, 24 aa, Plasmodium falciparum
NRDSLFFQFCKSQLLQKLFQFCSP

SEQ ID NO: 3391051 - protein, 27 aa, Plasmodium falciparum
NRDVISKILYQLLFEYIILCVNDSLND

SEQ ID NO: 3391052 - protein, 27 aa, Plasmodium falciparum
NREDTKVIFLLLDILCSLCRLNANAKI

SEQ ID NO: 3391053 - protein, 18 aa, Plasmodium falciparum
NRFKMFLTNYKKCHHVKS

SEQ ID NO: 3391054 - protein, 25 aa, Plasmodium falciparum
NRGGDNIYYIKYTDLYKLLNIKMND

SEQ ID NO: 3391055 - protein, 17 aa, Plasmodium falciparum
NRGIIKRNDYTDGNTTI

SEQ ID NO: 3391056 - protein, 18 aa, Plasmodium falciparum
NRGILVILIYEYVKNRDI

SEQ ID NO: 3391057 - protein, 23 aa, Plasmodium falciparum
NRGNILYYSHDKIWKILIYDKEG

SEQ ID NO: 3391058 - protein, 25 aa, Plasmodium falciparum
NRIDILDEALLRPGRIDRKIEFPNP

SEQ ID NO: 3391059 - protein, 26 aa, Plasmodium falciparum
NRIIDIDILFFNDFTIFMKNIKLEKN

SEQ ID NO: 3391060 - protein, 27 aa, Plasmodium falciparum
NRIINCPIKLIPLLYENVYEDILWSQQ

SEQ ID NO: 3391061 - protein, 18 aa, Plasmodium falciparum
NRIKKLPKLFGIPIVIKD

SEQ ID NO: 3391062 - protein, 18 aa, Plasmodium falciparum
NRIKQKALLLSYAQGRLN

SEQ ID NO: 3391063 - protein, 29 aa, Plasmodium falciparum
NRIVEMFTKEIINLSICQCPGVIKLHKVI

SEQ ID NO: 3391064 - protein, 27 aa, Plasmodium falciparum
NRKDKILFTYIIDEFLYRATIGSKFLN

SEQ ID NO: 3391065 - protein, 25 aa, Plasmodium falciparum
NRKKKNIYWLMKLQQKSTYLNELDF

SEQ ID NO: 3391066 - protein, 26 aa, Plasmodium falciparum
NRKNIKLFKINILNNILIYLSDENVN

SEQ ID NO: 3391067 - protein, 32 aa, Plasmodium falciparum
NRKQLNNDLIYFFPKYKLIIHPTLLNVNEQNN

SEQ ID NO: 3391068 - protein, 23 aa, Plasmodium falciparum
NRKTRILQLLKKKHKLLSEIYSN

SEQ ID NO: 3391069 - protein, 25 aa, Plasmodium falciparum
NRKVSLHCPFSLDRILIPCRGIMCS

SEQ ID NO: 3391070 - protein, 31 aa, Plasmodium falciparum
NRKVYSDSVLYFYGAPWWLNKIRRGQKIGQE

SEQ ID NO: 3391071 - protein, 20 aa, Plasmodium falciparum
NRLILLDPDWNPANDKQALA

SEQ ID NO: 3391072 - protein, 33 aa, Plasmodium falciparum
NRLKDLIEQLEKYSLLKFNYIMHSSYNMQEEYN

SEQ ID NO: 3391073 - protein, 29 aa, Plasmodium falciparum
NRLLPEHIIIPPRRLAILLHQSLKYQVDN

SEQ ID NO: 3391074 - protein, 17 aa, Plasmodium falciparum
NRLRKKKGEKIYMESDH

SEQ ID NO: 3391075 - protein, 18 aa, Plasmodium falciparum
NRLWWQIMRNEELKYVSV

SEQ ID NO: 3391076 - protein, 18 aa, Plasmodium falciparum
NRNGSILSNLNFLNTNNY

SEQ ID NO: 3391077 - protein, 26 aa, Plasmodium falciparum
NRNIENNAMLIIPKKKNNSTNVKGVK

SEQ ID NO: 3391078 - protein, 18 aa, Plasmodium falciparum
NRNIFYEKKSLYGMENIS

SEQ ID NO: 3391079 - protein, 25 aa, Plasmodium falciparum
NRNMNYNYAGYNHMYARCLNNNNMN

SEQ ID NO: 3391080 - protein, 17 aa, Plasmodium falciparum
NRNMYSQSLLNHRKLND

SEQ ID NO: 3391081 - protein, 26 aa, Plasmodium falciparum
NRNRNIFGRTYSYNRNTRNPRIITRA

SEQ ID NO: 3391082 - protein, 24 aa, Plasmodium falciparum
NRNRRLTTCLPIEQKTFINSYHMN

SEQ ID NO: 3391083 - protein, 18 aa, Plasmodium falciparum
NRNYDQVNIFGSVSNRNL

SEQ ID NO: 3391084 - protein, 18 aa, Plasmodium falciparum
NRNYTIETILISLRQEML

SEQ ID NO: 3391085 - protein, 17 aa, Plasmodium falciparum
NRQPFPQYGPINTPPSI

SEQ ID NO: 3391086 - protein, 24 aa, Plasmodium falciparum
NRRELINLIIFLIVVKKLSKTSQR

SEQ ID NO: 3391087 - protein, 17 aa, Plasmodium falciparum
NRRMSDISGLRKNNIGI

SEQ ID NO: 3391088 - protein, 29 aa, Plasmodium falciparum
NRRYPKRNRIKTLRYWIGERELTERNPYT

SEQ ID NO: 3391089 - protein, 19 aa, Plasmodium falciparum
NRSFYPEMPSLTEIQTKVV

SEQ ID NO: 3391090 - protein, 19 aa, Plasmodium falciparum
NRSLRLKFPWAMFATKNFT

SEQ ID NO: 3391091 - protein, 24 aa, Plasmodium falciparum
NRSSFLWSTLWKYFNTLKEERQKK

SEQ ID NO: 3391092 - protein, 30 aa, Plasmodium falciparum
NRVCETGILLYYKNRLIKRLDAPFIDTAYN

SEQ ID NO: 3391093 - protein, 26 aa, Plasmodium falciparum
NRVPYFIKVFSFSSLHILLKYSIRSF

SEQ ID NO: 3391094 - protein, 27 aa, Plasmodium falciparum
NRYGIFIHPDGTFYKGFWLNDKQNKNG

SEQ ID NO: 3391095 - protein, 21 aa, Plasmodium falciparum
NRYIIFHYYNFKNNTVNICYM

SEQ ID NO: 3391096 - protein, 20 aa, Plasmodium falciparum
NRYMNADYKTGQSTLPILSG

SEQ ID NO: 3391097 - protein, 23 aa, Plasmodium falciparum
NRYSHILPCDILPHGTQMPDINF

SEQ ID NO: 3391098 - protein, 23 aa, Plasmodium falciparum
NSALQVLLSIKDISYRYLNNISD

SEQ ID NO: 3391099 - protein, 17 aa, Plasmodium falciparum
NSCINILNKSKSQMMNK

SEQ ID NO: 3391100 - protein, 22 aa, Plasmodium falciparum
NSCKRLFDINVYMSKYPKGKEN

SEQ ID NO: 3391101 - protein, 23 aa, Plasmodium falciparum
NSCQQKMYMSQWLNNDGTKVKMK

SEQ ID NO: 3391102 - protein, 36 aa, Plasmodium falciparum
NSDDSILFNISNKNFYNFHLLFKKDEKLKKEFFLQN

SEQ ID NO: 3391103 - protein, 22 aa, Plasmodium falciparum
NSDIFNLPYRSYSSTVYSMDDC

SEQ ID NO: 3391104 - protein, 25 aa, Plasmodium falciparum
NSDIQLQLLINAFTLLHTGGVIIYS

SEQ ID NO: 3391105 - protein, 24 aa, Plasmodium falciparum
NSDQIYFDYFIYSFEMLYNYITKL

SEQ ID NO: 3391106 - protein, 27 aa, Plasmodium falciparum
NSDQNKYLYHFYKKKKVKLYLCLNKKN

SEQ ID NO: 3391107 - protein, 25 aa, Plasmodium falciparum
NSEDLLYKGNFYKNVRRAYKIENKQ

SEQ ID NO: 3391108 - protein, 30 aa, Plasmodium falciparum
NSEKLIKEIQLLNNISLRSATYLLKIEIEK

SEQ ID NO: 3391109 - protein, 34 aa, Plasmodium falciparum
NSENKNFVHLNNKIFKIMLNMYDGSFKKMEEDTN

SEQ ID NO: 3391110 - protein, 25 aa, Plasmodium falciparum
NSFEHGTISVIINKDKMKNFHVNQK

SEQ ID NO: 3391111 - protein, 21 aa, Plasmodium falciparum
NSFKIFIDNKLKKISFYILFE

SEQ ID NO: 3391112 - protein, 20 aa, Plasmodium falciparum
NSFKYFDALLLLSSFDKMNI

SEQ ID NO: 3391113 - protein, 25 aa, Plasmodium falciparum
NSFLKNIFHVFNNANFHLFKATFSS

SEQ ID NO: 3391114 - protein, 19 aa, Plasmodium falciparum
NSFNLIQHIPDSITNMCNT

SEQ ID NO: 3391115 - protein, 22 aa, Plasmodium falciparum
NSGIIVHSFVFHKNPIDLDKEN

SEQ ID NO: 3391116 - protein, 25 aa, Plasmodium falciparum
NSGKTLSYFLPILDNFYKSNERIMK

SEQ ID NO: 3391117 - protein, 20 aa, Plasmodium falciparum
NSGRYSVYAKRLDLNSFDPI

SEQ ID NO: 3391118 - protein, 24 aa, Plasmodium falciparum
NSHDKLFLFSIFSMYPSMSENNLL

SEQ ID NO: 3391119 - protein, 17 aa, Plasmodium falciparum
NSHLIFRPLADNNFFNI

SEQ ID NO: 3391120 - protein, 19 aa, Plasmodium falciparum
NSHLYLVLRRGMGLAWKAQ

SEQ ID NO: 3391121 - protein, 47 aa, Plasmodium falciparum
NSHVENIINMKPLIYYGKEKILHKGKFKKYYTTPPIPDNNNLYEIRM

SEQ ID NO: 3391122 - protein, 22 aa, Plasmodium falciparum
NSHVHLRTKNYIYKSPDNKRSQ

SEQ ID NO: 3391123 - protein, 20 aa, Plasmodium falciparum
NSHYDFCNVLIFYNKYDLIT

SEQ ID NO: 3391124 - protein, 28 aa, Plasmodium falciparum
NSIADKGLHIFVIPVLRHILEERGYEEM

SEQ ID NO: 3391125 - protein, 23 aa, Plasmodium falciparum
NSICFLKRFMPTNLYYFTKYNEE

SEQ ID NO: 3391126 - protein, 25 aa, Plasmodium falciparum
NSICNNPYLYINKKNKLKGNEKNSD

SEQ ID NO: 3391127 - protein, 21 aa, Plasmodium falciparum
NSIHLNQMFTKNTITSNKNSS

SEQ ID NO: 3391128 - protein, 28 aa, Plasmodium falciparum
NSIIISYDLIIPNIFIITPQVLKLFEDN

SEQ ID NO: 3391129 - protein, 19 aa, Plasmodium falciparum
NSIIKKIYTFYKNKDEKVV

SEQ ID NO: 3391130 - protein, 21 aa, Plasmodium falciparum
NSIILFGKTLTKFKKYKSISI

SEQ ID NO: 3391131 - protein, 17 aa, Plasmodium falciparum
NSIILFNKFKSIIEKNK

SEQ ID NO: 3391132 - protein, 24 aa, Plasmodium falciparum
NSIKMIYLVARFYNTPNKLNNLFI

SEQ ID NO: 3391133 - protein, 17 aa, Plasmodium falciparum
NSILLDKLIILELKNRN

SEQ ID NO: 3391134 - protein, 25 aa, Plasmodium falciparum
NSINKLYFFISYNNQGYKNCIVQDE

SEQ ID NO: 3391135 - protein, 27 aa, Plasmodium falciparum
NSINNIKNSMLLLNDIKRIVDSGANDS

SEQ ID NO: 3391136 - protein, 27 aa, Plasmodium falciparum
NSINSQVIVISLKEKFFSKSQSLIGVY

SEQ ID NO: 3391137 - protein, 27 aa, Plasmodium falciparum
NSINTKVKYPILKTITIISDGKNDINK

SEQ ID NO: 3391138 - protein, 22 aa, Plasmodium falciparum
NSIQLNQISQKFLRSHQNVVNN

SEQ ID NO: 3391139 - protein, 32 aa, Plasmodium falciparum
NSISKYVMPLKSEYYFIIQYNAIKEKINTNNF

SEQ ID NO: 3391140 - protein, 23 aa, Plasmodium falciparum
NSITLLGQLFQTKKAREVWVFGI

SEQ ID NO: 3391141 - protein, 28 aa, Plasmodium falciparum
NSITPTFCTCILYINSINWYGVPIIFKS

SEQ ID NO: 3391142 - protein, 23 aa, Plasmodium falciparum
NSKDFSLLLERHKYNKMGNHQYV

SEQ ID NO: 3391143 - protein, 17 aa, Plasmodium falciparum
NSKENINFIKKDSQYLL

SEQ ID NO: 3391144 - protein, 35 aa, Plasmodium falciparum
NSKEPKISKYLLKKWGFNKAHSLAVHTVKCAYKAV

SEQ ID NO: 3391145 - protein, 43 aa, Plasmodium falciparum
NSKESIKYIFKYYPYQITTTLFYPFKNFLFIYNDDIIPHELLS

SEQ ID NO: 3391146 - protein, 29 aa, Plasmodium falciparum
NSKFDHVKSGNLLLIDLAGNEKYAASNEK

SEQ ID NO: 3391147 - protein, 19 aa, Plasmodium falciparum
NSKFILKRSYKENFIKSML

SEQ ID NO: 3391148 - protein, 28 aa, Plasmodium falciparum
NSKLSRLIYLQIIKDLFIPNKNTFCILI

SEQ ID NO: 3391149 - protein, 22 aa, Plasmodium falciparum
NSKSILISRLTLKYDPRISGWK

SEQ ID NO: 3391150 - protein, 22 aa, Plasmodium falciparum
NSKWNYLTMNNIYFYNNFNDNF

SEQ ID NO: 3391151 - protein, 27 aa, Plasmodium falciparum
NSKYENYRNYPYYPRASNLPYNNETMI

SEQ ID NO: 3391152 - protein, 17 aa, Plasmodium falciparum
NSKYLIDLIYNLQEYLN

SEQ ID NO: 3391153 - protein, 19 aa, Plasmodium falciparum
NSLDYIFKPRSIGIIGATE

SEQ ID NO: 3391154 - protein, 27 aa, Plasmodium falciparum
NSLEELWSLLHFLMPNIFTSHLDFKEW

SEQ ID NO: 3391155 - protein, 17 aa, Plasmodium falciparum
NSLFFGLNEEYLNLLEE

SEQ ID NO: 3391156 - protein, 39 aa, Plasmodium falciparum
NSLFTFKDYIKNVIYFLSKIFHYNFLDYTYIKNYSLTNY

SEQ ID NO: 3391157 - protein, 27 aa, Plasmodium falciparum
NSLIFINYNHRLFFYKYNGINMPLSLK

SEQ ID NO: 3391158 - protein, 25 aa, Plasmodium falciparum
NSLIGCISCMYEGTKMYCHCHNINN

SEQ ID NO: 3391159 - protein, 60 aa, Plasmodium falciparum
NSLKEGILYKIGKHLHQFKARYYILFDNLLYYYDKKRNLKPRGFMFLEGCYVELIAKNDN

SEQ ID NO: 3391160 - protein, 21 aa, Plasmodium falciparum
NSLKNIILLSYKNYDAYLLNL

SEQ ID NO: 3391161 - protein, 23 aa, Plasmodium falciparum
NSLLADMWCFSKNSWTPIKQIDR

SEQ ID NO: 3391162 - protein, 18 aa, Plasmodium falciparum
NSLLQYSYLLGKVGTEKK

SEQ ID NO: 3391163 - protein, 23 aa, Plasmodium falciparum
NSLLVSLILPHKFEKNKKIYPSN

SEQ ID NO: 3391164 - protein, 22 aa, Plasmodium falciparum
NSLRIFRFYRLGEVFSQNILHL

SEQ ID NO: 3391165 - protein, 19 aa, Plasmodium falciparum
NSMFIFDLRYKYPSTCLYN

SEQ ID NO: 3391166 - protein, 22 aa, Plasmodium falciparum
NSMLCNNLALYLKDACLNLGKE

SEQ ID NO: 3391167 - protein, 19 aa, Plasmodium falciparum
NSMPYSIRKNKLSYNKDLL

SEQ ID NO: 3391168 - protein, 23 aa, Plasmodium falciparum
NSNCAIFLDLLKALILNHKDDNY

SEQ ID NO: 3391169 - protein, 24 aa, Plasmodium falciparum
NSNDGLYNNVNFKNNIISEGEEES

SEQ ID NO: 3391170 - protein, 25 aa, Plasmodium falciparum
NSNELQIYAWIDITMREIVTLVKDF

SEQ ID NO: 3391171 - protein, 22 aa, Plasmodium falciparum
NSNFFFVKYVHLKDAIKAYENL

SEQ ID NO: 3391172 - protein, 17 aa, Plasmodium falciparum
NSNIYPFYKNTSINNCN

SEQ ID NO: 3391173 - protein, 33 aa, Plasmodium falciparum
NSNKRLLKQWEKILRDNVLKLLKNDNNAFYFKT

SEQ ID NO: 3391174 - protein, 25 aa, Plasmodium falciparum
NSNKYNLYLKNILLHGPPGTGKTLF

SEQ ID NO: 3391175 - protein, 21 aa, Plasmodium falciparum
NSNMNKIHYPSPNKLKKMNSI

SEQ ID NO: 3391176 - protein, 29 aa, Plasmodium falciparum
NSNMYNMFFGLYGMQFVEFTIPVFYCSKE

SEQ ID NO: 3391177 - protein, 19 aa, Plasmodium falciparum
NSNPFILDNSIRKSNIIIT

SEQ ID NO: 3391178 - protein, 25 aa, Plasmodium falciparum
NSNRAVVMPLKNKIIYINDANITND

SEQ ID NO: 3391179 - protein, 23 aa, Plasmodium falciparum
NSNSFFGSAFGKTNELNKGSNPF

SEQ ID NO: 3391180 - protein, 17 aa, Plasmodium falciparum
NSNTFSFNLKPPSNDKN

SEQ ID NO: 3391181 - protein, 28 aa, Plasmodium falciparum
NSNWIYCPIDGRKYSDGLYYKSSDNLEN

SEQ ID NO: 3391182 - protein, 21 aa, Plasmodium falciparum
NSNYYYMNNGYDNSSYQYNLA

SEQ ID NO: 3391183 - protein, 18 aa, Plasmodium falciparum
NSPCLTKEDFFNCAGNNN

SEQ ID NO: 3391184 - protein, 24 aa, Plasmodium falciparum
NSPLLLNYTILKIMYEYYNLLDID

SEQ ID NO: 3391185 - protein, 26 aa, Plasmodium falciparum
NSPNHKLICFIVSKQIPHQNTMHYSK

SEQ ID NO: 3391186 - protein, 25 aa, Plasmodium falciparum
NSPPVPPTCPPPPTPPAPPGQPTQS

SEQ ID NO: 3391187 - protein, 18 aa, Plasmodium falciparum
NSQMDFDEMLFDWRKKKI

SEQ ID NO: 3391188 - protein, 25 aa, Plasmodium falciparum
NSQNIIPPIMFPYNNSNDYTNTNIN

SEQ ID NO: 3391189 - protein, 25 aa, Plasmodium falciparum
NSQSLKLYPLINNNAYVNIKRDVSK

SEQ ID NO: 3391190 - protein, 30 aa, Plasmodium falciparum
NSRNIISNNYYFPEFNKSSLFYKNNNLYNI

SEQ ID NO: 3391191 - protein, 28 aa, Plasmodium falciparum
NSSCADILLFANYKWGISKPSLLTDEDH

SEQ ID NO: 3391192 - protein, 26 aa, Plasmodium falciparum
NSSENFMKIYKNILKQNYHVEKFKKQ

SEQ ID NO: 3391193 - protein, 25 aa, Plasmodium falciparum
NSSGQIFCMPLNLNIKKIKEEHIKE

SEQ ID NO: 3391194 - protein, 25 aa, Plasmodium falciparum
NSSIRLLKNWPQLEKTYQTNPPCIP

SEQ ID NO: 3391195 - protein, 24 aa, Plasmodium falciparum
NSSKNNAVILKKEKLKTNGNIIND

SEQ ID NO: 3391196 - protein, 26 aa, Plasmodium falciparum
NSSLPYANEWLFDKIKEILDPSINQE

SEQ ID NO: 3391197 - protein, 25 aa, Plasmodium falciparum
NSSNFLENTFKYINENPLKKNLQNK

SEQ ID NO: 3391198 - protein, 17 aa, Plasmodium falciparum
NSSNKYFQINQLHFIRI

SEQ ID NO: 3391199 - protein, 28 aa, Plasmodium falciparum
NSSNNLHYLNELIFNSNLFHGNNMGYHE

SEQ ID NO: 3391200 - protein, 22 aa, Plasmodium falciparum
NSSNVLKFKHDHNHYINMTNGN

SEQ ID NO: 3391201 - protein, 27 aa, Plasmodium falciparum
NSSSSNGLIYHYPNYDKIKTNAPKGIL

SEQ ID NO: 3391202 - protein, 32 aa, Plasmodium falciparum
NSSTRNNKILPYYYFFDLNNFTQNMKQNLYFK

SEQ ID NO: 3391203 - protein, 27 aa, Plasmodium falciparum
NSSYNYNMENLYDSSLKYVKNANNLNK

SEQ ID NO: 3391204 - protein, 27 aa, Plasmodium falciparum
NSTILNLDNLNIFLKKNENPMDYYKVY

SEQ ID NO: 3391205 - protein, 25 aa, Plasmodium falciparum
NSTLHKIYNFIFPSSVKKLQKKKQK

SEQ ID NO: 3391206 - protein, 17 aa, Plasmodium falciparum
NSTNTNINLLKPSIRKM

SEQ ID NO: 3391207 - protein, 22 aa, Plasmodium falciparum
NSTVNYFFPWKNSSYNIIAHET

SEQ ID NO: 3391208 - protein, 27 aa, Plasmodium falciparum
NSVDELPSFRFLYLMKTGDNNITNYNI

SEQ ID NO: 3391209 - protein, 29 aa, Plasmodium falciparum
NSVETFEYLLLLKLLFPKNITLLRGNHES

SEQ ID NO: 3391210 - protein, 19 aa, Plasmodium falciparum
NSVFVNGLLCLLCNMKINY

SEQ ID NO: 3391211 - protein, 19 aa, Plasmodium falciparum
NSVIYIFKKTNMKVCCIEA

SEQ ID NO: 3391212 - protein, 22 aa, Plasmodium falciparum
NSVLYFLKYFLKNTNKYNIMCE

SEQ ID NO: 3391213 - protein, 32 aa, Plasmodium falciparum
NSVSQKWIVRGFYRIGIFALRDIPSGEEITYN

SEQ ID NO: 3391214 - protein, 22 aa, Plasmodium falciparum
NSWNYINAKYNKWIKKSNRKNI

SEQ ID NO: 3391215 - protein, 21 aa, Plasmodium falciparum
NSYIPLSNVQCNWKNHIFNVT

SEQ ID NO: 3391216 - protein, 28 aa, Plasmodium falciparum
NSYKNSFDHINPSTLYDFILSTNNANNI

SEQ ID NO: 3391217 - protein, 26 aa, Plasmodium falciparum
NSYLLRNRAFRLTWTSIIEKIKHEID

SEQ ID NO: 3391218 - protein, 23 aa, Plasmodium falciparum
NSYNKEYNILFDKKNISNLNDNN

SEQ ID NO: 3391219 - protein, 24 aa, Plasmodium falciparum
NSYNNFLFHLNSFKTLLHELSQNI

SEQ ID NO: 3391220 - protein, 28 aa, Plasmodium falciparum
NSYPNFHLADLFYLLQLPNISINERNDL

SEQ ID NO: 3391221 - protein, 20 aa, Plasmodium falciparum
NSYQYNSIPQFNSSSRFNNI

SEQ ID NO: 3391222 - protein, 19 aa, Plasmodium falciparum
NTAFYSILCIINNIYKCTY

SEQ ID NO: 3391223 - protein, 17 aa, Plasmodium falciparum
NTAWYNNTLGNKLYVYE

SEQ ID NO: 3391224 - protein, 21 aa, Plasmodium falciparum
NTCLTYLLEKTTTLIIEQFYD

SEQ ID NO: 3391225 - protein, 28 aa, Plasmodium falciparum
NTDDLQNKIFFFLKDTIQKYKNIQAFHQ

SEQ ID NO: 3391226 - protein, 22 aa, Plasmodium falciparum
NTDNYFFEDTFKGNMMNTSSVN

SEQ ID NO: 3391227 - protein, 17 aa, Plasmodium falciparum
NTDYCNVIIQLICSIIP

SEQ ID NO: 3391228 - protein, 36 aa, Plasmodium falciparum
NTEKLNAIKKERLSRLFLYIEDIHKLKQALKVKQHN

SEQ ID NO: 3391229 - protein, 29 aa, Plasmodium falciparum
NTENYFFSLPLIPLTLFQKIKSEFIKFQV

SEQ ID NO: 3391230 - protein, 27 aa, Plasmodium falciparum
NTENYKFLISILYFHKKSFSLFAIIEN

SEQ ID NO: 3391231 - protein, 25 aa, Plasmodium falciparum
NTESKILHYSPFNDLRIFGFDIEDF

SEQ ID NO: 3391232 - protein, 48 aa, Plasmodium falciparum
NTEVTYMDFILSYLIFNDTFFFKYIQKIQIEMLPFIQALEKNFDNRMN

SEQ ID NO: 3391233 - protein, 25 aa, Plasmodium falciparum
NTFENKVYLFVQNPEAMRLVRKLEK

SEQ ID NO: 3391234 - protein, 58 aa, Plasmodium falciparum
NTFFDYYQNIIVFKTVVLPNHVSSHSFWLYLYINLEEAFTFSSLLHGIVEIKIESVDE

SEQ ID NO: 3391235 - protein, 29 aa, Plasmodium falciparum
NTFFSFVTCFPVYFFDVFTIRCTAEYKIG

SEQ ID NO: 3391236 - protein, 34 aa, Plasmodium falciparum
NTFLINDDIYNLIKLLFDILNFNTDYSYIKLGQD

SEQ ID NO: 3391237 - protein, 28 aa, Plasmodium falciparum
NTFLKKKLRILFHKFLNKKVKNYLNSSE

SEQ ID NO: 3391238 - protein, 29 aa, Plasmodium falciparum
NTFNKCNELWFHKLWIIKYGLKDNLIDMK

SEQ ID NO: 3391239 - protein, 23 aa, Plasmodium falciparum
NTGKLIIFNLPPINEQDIKSLCE

SEQ ID NO: 3391240 - protein, 24 aa, Plasmodium falciparum
NTGNRFKWEYLDVCGNIQEGKDRA

SEQ ID NO: 3391241 - protein, 25 aa, Plasmodium falciparum
NTHEKYYKTLPSRTKYYKDSDTIFD

SEQ ID NO: 3391242 - protein, 32 aa, Plasmodium falciparum
NTHFAHNYHISLFFFCKYTSYNLYLHPLNKNE

SEQ ID NO: 3391243 - protein, 19 aa, Plasmodium falciparum
NTHIHYFKQIKNKKLKILK

SEQ ID NO: 3391244 - protein, 18 aa, Plasmodium falciparum
NTHKYIPIKDIIPDHTTN

SEQ ID NO: 3391245 - protein, 17 aa, Plasmodium falciparum
NTHRYMELLYSAADKCL

SEQ ID NO: 3391246 - protein, 48 aa, Plasmodium falciparum
NTILYFKEFDCKVFGFLYACFLSLEYKQLYLDYFLNEKKQDYLLNLIQ

SEQ ID NO: 3391247 - protein, 20 aa, Plasmodium falciparum
NTINKVLTYVYPSNFTSNYN

SEQ ID NO: 3391248 - protein, 20 aa, Plasmodium falciparum
NTINLLKHKGKYIHYEDFND

SEQ ID NO: 3391249 - protein, 26 aa, Plasmodium falciparum
NTINSPLPFSPTYNANLLSPTAPIDN

SEQ ID NO: 3391250 - protein, 21 aa, Plasmodium falciparum
NTINYFGVPIKLKRSKQRITF

SEQ ID NO: 3391251 - protein, 23 aa, Plasmodium falciparum
NTKLKEFVTFLNAFKEIDTMLID

SEQ ID NO: 3391252 - protein, 31 aa, Plasmodium falciparum
NTKNKGVWYNARTKCWLACVKGSGRHLRVFS

SEQ ID NO: 3391253 - protein, 24 aa, Plasmodium falciparum
NTKRLYVKYKYELPTIASLGKVKK

SEQ ID NO: 3391254 - protein, 18 aa, Plasmodium falciparum
NTKTLWVGDLEKIKDEVV

SEQ ID NO: 3391255 - protein, 27 aa, Plasmodium falciparum
NTLALYIAYCRITCNPIISLESKKIII

SEQ ID NO: 3391256 - protein, 24 aa, Plasmodium falciparum
NTLDDVILPCLKKAYQTSTDFLSS

SEQ ID NO: 3391257 - protein, 22 aa, Plasmodium falciparum
NTLDNYLCCFSNIKICAVKSIF

SEQ ID NO: 3391258 - protein, 21 aa, Plasmodium falciparum
NTLKEGSLLRLFRCEYFDTHL

SEQ ID NO: 3391259 - protein, 23 aa, Plasmodium falciparum
NTLKKAWLEDFYNFIRKLGGKTE

SEQ ID NO: 3391260 - protein, 27 aa, Plasmodium falciparum
NTLLRNNILSSEYFKSLIPIKTFKEVV

SEQ ID NO: 3391261 - protein, 32 aa, Plasmodium falciparum
NTLNSINSNHLYYPFPFHNNVNSPKMVGMCDV

SEQ ID NO: 3391262 - protein, 30 aa, Plasmodium falciparum
NTLNTSLINSLLYFALHSYINNLNTLIFCC

SEQ ID NO: 3391263 - protein, 33 aa, Plasmodium falciparum
NTMKQIWEYIRLFYNIICYIDPIDLVKSLTYQK

SEQ ID NO: 3391264 - protein, 27 aa, Plasmodium falciparum
NTMLYNMKEYPLYNITWRRIIIDEAHV

SEQ ID NO: 3391265 - protein, 20 aa, Plasmodium falciparum
NTNCYASVLYVPPEHAKSAM

SEQ ID NO: 3391266 - protein, 24 aa, Plasmodium falciparum
NTNDTYFILIKVKIKNHLNSPKLD

SEQ ID NO: 3391267 - protein, 34 aa, Plasmodium falciparum
NTNFLVYNMAKYIKWILLIIIEKGIALTNRSNII

SEQ ID NO: 3391268 - protein, 24 aa, Plasmodium falciparum
NTNGCQFFIITKKCEWLDGKNVVF

SEQ ID NO: 3391269 - protein, 23 aa, Plasmodium falciparum
NTNILVNVLNDLKCINLPKKESA

SEQ ID NO: 3391270 - protein, 17 aa, Plasmodium falciparum
NTNKNIINLYENNFKSI

SEQ ID NO: 3391271 - protein, 25 aa, Plasmodium falciparum
NTNKYEPKWFYKHKDPIFNDRDIYL

SEQ ID NO: 3391272 - protein, 19 aa, Plasmodium falciparum
NTNLRFIFHNTFITSEEEI

SEQ ID NO: 3391273 - protein, 23 aa, Plasmodium falciparum
NTNNISFKKISIGHNFILGVDMH

SEQ ID NO: 3391274 - protein, 26 aa, Plasmodium falciparum
NTNSSQFFITLVPCPWLDGKHVVFGK

SEQ ID NO: 3391275 - protein, 22 aa, Plasmodium falciparum
NTNTLIRMNYDAKTFDASATIK

SEQ ID NO: 3391276 - protein, 21 aa, Plasmodium falciparum
NTNWRNIFFLEDIQIHLNNKK

SEQ ID NO: 3391277 - protein, 25 aa, Plasmodium falciparum
NTPLNKYFYIFYKNEKYLSEVEIIH

SEQ ID NO: 3391278 - protein, 20 aa, Plasmodium falciparum
NTPNILPNRHNSMYPSNGNH

SEQ ID NO: 3391279 - protein, 29 aa, Plasmodium falciparum
NTPVKITPYLMFTPAKKPMIPVKIKEKIK

SEQ ID NO: 3391280 - protein, 22 aa, Plasmodium falciparum
NTPYYDYFDLYVKTLNEMHNHI

SEQ ID NO: 3391281 - protein, 25 aa, Plasmodium falciparum
NTQCFYILGCKEFKVIDFFTIYRLD

SEQ ID NO: 3391282 - protein, 27 aa, Plasmodium falciparum
NTQQQDLLLSYLLLESLYSIPDENLPM

SEQ ID NO: 3391283 - protein, 36 aa, Plasmodium falciparum
NTRIIKICERLMLHKSMYIAILALDLRRKIGNLKEN

SEQ ID NO: 3391284 - protein, 25 aa, Plasmodium falciparum
NTRNNAYDYMLRSKNNFPNYMNNPN

SEQ ID NO: 3391285 - protein, 53 aa, Plasmodium falciparum
NTRNPRIITRAIDITNIPFNSPGRFNFHDLIDNMFANTFDNISLDQVLTIIME

SEQ ID NO: 3391286 - protein, 26 aa, Plasmodium falciparum
NTRNYYYEIFLSTLKKIYLKNIKILI

SEQ ID NO: 3391287 - protein, 27 aa, Plasmodium falciparum
NTSDILKLFPIIKILSKAFDESSKFSL

SEQ ID NO: 3391288 - protein, 24 aa, Plasmodium falciparum
NTSEFCKNISLPLDVLENEKKLKS

SEQ ID NO: 3391289 - protein, 22 aa, Plasmodium falciparum
NTSFLLFPRSSISKTPLRLANS

SEQ ID NO: 3391290 - protein, 24 aa, Plasmodium falciparum
NTSKYTLYNFLRKKLHKMVEFHYL

SEQ ID NO: 3391291 - protein, 17 aa, Plasmodium falciparum
NTSREYIYTILKNRLLG

SEQ ID NO: 3391292 - protein, 17 aa, Plasmodium falciparum
NTSSFILFFENMRMTKK

SEQ ID NO: 3391293 - protein, 44 aa, Plasmodium falciparum
NTSSINRIKSLYADSWRNTLIPSTYILPFLETKLVDKNLMKLSE

SEQ ID NO: 3391294 - protein, 19 aa, Plasmodium falciparum
NTSYSFYFNINLNYFTCDE

SEQ ID NO: 3391295 - protein, 23 aa, Plasmodium falciparum
NTTIIPPLHRQSNSNFPFKNTKL

SEQ ID NO: 3391296 - protein, 29 aa, Plasmodium falciparum
NTTLFLRHYNNHLLLINGNKIKFYNYEEN

SEQ ID NO: 3391297 - protein, 30 aa, Plasmodium falciparum
NTTNHPYKLIIPKQIKPTPLLLNSQKKNEN

SEQ ID NO: 3391298 - protein, 25 aa, Plasmodium falciparum
NTTRRTWKCVCGLQKLYKNLKRAKN

SEQ ID NO: 3391299 - protein, 23 aa, Plasmodium falciparum
NTTRVKLLYDNEVLYVCFNKENG

SEQ ID NO: 3391300 - protein, 22 aa, Plasmodium falciparum
NTTYQYFSIFGSTAMCLIKPIF

SEQ ID NO: 3391301 - protein, 29 aa, Plasmodium falciparum
NTVKFLNTYKMPITLSFKIPMFTSSGMYI

SEQ ID NO: 3391302 - protein, 24 aa, Plasmodium falciparum
NTVLPYLPMLFERALKGKDIQSLL

SEQ ID NO: 3391303 - protein, 25 aa, Plasmodium falciparum
NTVVEILIHYIKTPNWLKVFETCIP

SEQ ID NO: 3391304 - protein, 24 aa, Plasmodium falciparum
NTWDRFELRIYKRLIDLYSQCEVV

SEQ ID NO: 3391305 - protein, 47 aa, Plasmodium falciparum
NTYAECLLNFIYALDYIKYNVPLYYNKTYYVLRKISLEIIKEIEKLT

SEQ ID NO: 3391306 - protein, 30 aa, Plasmodium falciparum
NTYINSYEFLLDILIFFNNNNIMQGEIERM

SEQ ID NO: 3391307 - protein, 29 aa, Plasmodium falciparum
NTYNVHILDIYIYLYLRNYLKHTSNTEDE

SEQ ID NO: 3391308 - protein, 29 aa, Plasmodium falciparum
NTYYNYKYLFIYRKLILSLIYDMEKKQKT

SEQ ID NO: 3391309 - protein, 20 aa, Plasmodium falciparum
NVAKMLLKGNLNTANFILDD

SEQ ID NO: 3391310 - protein, 27 aa, Plasmodium falciparum
NVCEDTPLDIFLMLDNDVKIKTSGSSN

SEQ ID NO: 3391311 - protein, 20 aa, Plasmodium falciparum
NVCGLLCIKSPWPGMLRTVY

SEQ ID NO: 3391312 - protein, 23 aa, Plasmodium falciparum
NVCGNLLCEEKCNNYRQIDKNEK

SEQ ID NO: 3391313 - protein, 30 aa, Plasmodium falciparum
NVCIIECIYHYLQLFKYEGIDFKTVIDNQE

SEQ ID NO: 3391314 - protein, 19 aa, Plasmodium falciparum
NVCLIMASNNLENIPEDKK

SEQ ID NO: 3391315 - protein, 20 aa, Plasmodium falciparum
NVDCVSGLGDFPECIKNIIN

SEQ ID NO: 3391316 - protein, 18 aa, Plasmodium falciparum
NVDDIIKITKWNNDMELS

SEQ ID NO: 3391317 - protein, 23 aa, Plasmodium falciparum
NVDFLYLNVLIHNRKLQYDDLMK

SEQ ID NO: 3391318 - protein, 23 aa, Plasmodium falciparum
NVDKFNYEDFFFGSISNNHPNNN

SEQ ID NO: 3391319 - protein, 22 aa, Plasmodium falciparum
NVDVYSYGYMPDNIPVNVVYNN

SEQ ID NO: 3391320 - protein, 21 aa, Plasmodium falciparum
NVECFHNLNLPKRSHTTIIPN

SEQ ID NO: 3391321 - protein, 32 aa, Plasmodium falciparum
NVEEKNLLINFFLQFPSLNKKLEYNKKRIYAE

SEQ ID NO: 3391322 - protein, 27 aa, Plasmodium falciparum
NVEILRYHLHKLLYNLVIHVCKKQNTL

SEQ ID NO: 3391323 - protein, 27 aa, Plasmodium falciparum
NVEKIIYYLNPCSILCAYFLDIKQNEH

SEQ ID NO: 3391324 - protein, 29 aa, Plasmodium falciparum
NVESENCWLSKVASYILPSAKKNNESIKK

SEQ ID NO: 3391325 - protein, 19 aa, Plasmodium falciparum
NVEYIPIKRLTYKNASKKT

SEQ ID NO: 3391326 - protein, 19 aa, Plasmodium falciparum
NVFDLIEIIKYLGKQIIKN

SEQ ID NO: 3391327 - protein, 22 aa, Plasmodium falciparum
NVFEVFLPQLLTYPNPSDPLNS

SEQ ID NO: 3391328 - protein, 20 aa, Plasmodium falciparum
NVFHNKLPLNYLLYQLNIAG

SEQ ID NO: 3391329 - protein, 18 aa, Plasmodium falciparum
NVFILKNKKIKIGYNNKV

SEQ ID NO: 3391330 - protein, 42 aa, Plasmodium falciparum
NVFIQTLYHFMFQYVKLYYTFKKVIFRNLYYHISLPNKAEVE

SEQ ID NO: 3391331 - protein, 20 aa, Plasmodium falciparum
NVFKIYTYEGTLVNSYNFNE

SEQ ID NO: 3391332 - protein, 20 aa, Plasmodium falciparum
NVFMDIFRAIIFKINSKKKN

SEQ ID NO: 3391333 - protein, 19 aa, Plasmodium falciparum
NVFVLPVIPEKIIPEYSSS

SEQ ID NO: 3391334 - protein, 20 aa, Plasmodium falciparum
NVFWDGFQWVAKTNQTNPHH

SEQ ID NO: 3391335 - protein, 17 aa, Plasmodium falciparum
NVFYFNVKNLVQQFLEK

SEQ ID NO: 3391336 - protein, 18 aa, Plasmodium falciparum
NVGFIKDICYFNKSKKQM

SEQ ID NO: 3391337 - protein, 24 aa, Plasmodium falciparum
NVGLSYIYYYMNNNDMFSKNVYKI

SEQ ID NO: 3391338 - protein, 17 aa, Plasmodium falciparum
NVGVYFTGFRKNSKNIQ

SEQ ID NO: 3391339 - protein, 25 aa, Plasmodium falciparum
NVHNFQVFQLIAYILHQIKNKYKLL

SEQ ID NO: 3391340 - protein, 28 aa, Plasmodium falciparum
NVHNNENMWGYFNEGALYNFSSIYNAKQ

SEQ ID NO: 3391341 - protein, 45 aa, Plasmodium falciparum
NVHNPYVNYCALLPFLTKEDFYLFRKLQRIYKEKYLKKLYKHVKQ

SEQ ID NO: 3391342 - protein, 29 aa, Plasmodium falciparum
NVHPSYKQWMKILRTVWFVSALVKARRQK

SEQ ID NO: 3391343 - protein, 23 aa, Plasmodium falciparum
NVHPTKFIFMGKKKKKIIEHEGT

SEQ ID NO: 3391344 - protein, 25 aa, Plasmodium falciparum
NVHRQLLFCSYLDNINKNFTAYVKN

SEQ ID NO: 3391345 - protein, 27 aa, Plasmodium falciparum
NVIEIFERKIIYLSFINEEILEKLNEH

SEQ ID NO: 3391346 - protein, 27 aa, Plasmodium falciparum
NVIEIFEVLLGFIYFNRPRNIIEFIID

SEQ ID NO: 3391347 - protein, 22 aa, Plasmodium falciparum
NVIICTDSILKNIYPFFKTEED

SEQ ID NO: 3391348 - protein, 17 aa, Plasmodium falciparum
NVIIFNDVINSTWKDDV

SEQ ID NO: 3391349 - protein, 24 aa, Plasmodium falciparum
NVIIQLICSIIPLRNTLLLYECKE

SEQ ID NO: 3391350 - protein, 18 aa, Plasmodium falciparum
NVIKKIVLNCKCKKLKEE

SEQ ID NO: 3391351 - protein, 22 aa, Plasmodium falciparum
NVIKKIYKLKILNKLPLQFKKD

SEQ ID NO: 3391352 - protein, 18 aa, Plasmodium falciparum
NVIKRLGIDSYIFARGNR

SEQ ID NO: 3391353 - protein, 17 aa, Plasmodium falciparum
NVIMIYTCEWPSLFIEW

SEQ ID NO: 3391354 - protein, 29 aa, Plasmodium falciparum
NVINVHLSILLFPLCFYDFDSRWYRCIEN

SEQ ID NO: 3391355 - protein, 24 aa, Plasmodium falciparum
NVKDFFSVKILNKGYWPTLEKIHI

SEQ ID NO: 3391356 - protein, 41 aa, Plasmodium falciparum
NVKDLLKIQYEYLDIVYLSVKSFFQLVEWKKNSIRDILCSY

SEQ ID NO: 3391357 - protein, 25 aa, Plasmodium falciparum
NVKDLNYELLIVSQFTLFGNTKKGN

SEQ ID NO: 3391358 - protein, 21 aa, Plasmodium falciparum
NVKDVFLERMGNKFMSSYKKF

SEQ ID NO: 3391359 - protein, 20 aa, Plasmodium falciparum
NVKEFLIREGICALEHIRIH

SEQ ID NO: 3391360 - protein, 27 aa, Plasmodium falciparum
NVKENDMKVIWPNKLSWKEISNEIKKK

SEQ ID NO: 3391361 - protein, 22 aa, Plasmodium falciparum
NVKGKGKGIRRNLRGRKGKNKK

SEQ ID NO: 3391362 - protein, 29 aa, Plasmodium falciparum
NVKGLVPLKKFMGSKRFPPTKRFTNNNNN

SEQ ID NO: 3391363 - protein, 18 aa, Plasmodium falciparum
NVKIIGRQYAIMKAFSIL

SEQ ID NO: 3391364 - protein, 24 aa, Plasmodium falciparum
NVKKLDLVFFDDSLKHLIIINRVM

SEQ ID NO: 3391365 - protein, 29 aa, Plasmodium falciparum
NVKKSFTSMILNFFGFKYDNIEEDKKSEN

SEQ ID NO: 3391366 - protein, 27 aa, Plasmodium falciparum
NVKKYILEYLALYILNKNIKSKILLLV

SEQ ID NO: 3391367 - protein, 17 aa, Plasmodium falciparum
NVKLKNYVQNHNTQQMD

SEQ ID NO: 3391368 - protein, 36 aa, Plasmodium falciparum
NVKQYIVTTLNIYCALNIFKLIRRGRYTICKYENFD

SEQ ID NO: 3391369 - protein, 22 aa, Plasmodium falciparum
NVKSYPLDKLHKHVKSIILENQ

SEQ ID NO: 3391370 - protein, 30 aa, Plasmodium falciparum
NVKYQKGAYIIYYKLRPGVIEFLRTMSEKY

SEQ ID NO: 3391371 - protein, 19 aa, Plasmodium falciparum
NVLCNSHLPFSIKLKNNFL

SEQ ID NO: 3391372 - protein, 25 aa, Plasmodium falciparum
NVLIHFSFYNYDFGNLILFPNVDKN

SEQ ID NO: 3391373 - protein, 30 aa, Plasmodium falciparum
NVLKNALHISYMNPFYFKKTDELQKKDKDQ

SEQ ID NO: 3391374 - protein, 28 aa, Plasmodium falciparum
NVLPFQDIQRLILYINSINLNDMSEKDI

SEQ ID NO: 3391375 - protein, 18 aa, Plasmodium falciparum
NVLSRLYQLKKIHDNADS

SEQ ID NO: 3391376 - protein, 26 aa, Plasmodium falciparum
NVLTNEYYIPIPKYMKNKIKIKEENF

SEQ ID NO: 3391377 - protein, 37 aa, Plasmodium falciparum
NVLVLNSIKIAYIFLKKNGIFITKVFRNEEYISLIWV

SEQ ID NO: 3391378 - protein, 21 aa, Plasmodium falciparum
NVLVQGGIVSPYMESLKNEKG

SEQ ID NO: 3391379 - protein, 19 aa, Plasmodium falciparum
NVLYEQKYERNHSENMSIY

SEQ ID NO: 3391380 - protein, 17 aa, Plasmodium falciparum
NVMGPKKWKKEVYNIDQ

SEQ ID NO: 3391381 - protein, 39 aa, Plasmodium falciparum
NVMSTFSFWNIEKETFITKPLYAQNLRKKQFSLLDESEE

SEQ ID NO: 3391382 - protein, 29 aa, Plasmodium falciparum
NVNDRFVEKIYYLLKDKKKNMLPEEELVE

SEQ ID NO: 3391383 - protein, 36 aa, Plasmodium falciparum
NVNEHKEFFDIYKKKLFLNADILKEILYGGPDDFNS

SEQ ID NO: 3391384 - protein, 25 aa, Plasmodium falciparum
NVNFSFRFPTFIAILQFCSQNNIFH

SEQ ID NO: 3391385 - protein, 26 aa, Plasmodium falciparum
NVNHPEQLYLKGKFVPKYKINNEHDI

SEQ ID NO: 3391386 - protein, 17 aa, Plasmodium falciparum
NVNIEDIFLYKPTTKYT

SEQ ID NO: 3391387 - protein, 27 aa, Plasmodium falciparum
NVNIPAPLLSRFDLFYTMLDCIDIDKD

SEQ ID NO: 3391388 - protein, 26 aa, Plasmodium falciparum
NVNNMNNMFNVNPQLNIMGIMKDINN

SEQ ID NO: 3391389 - protein, 54 aa, Plasmodium falciparum
NVNSLNTVFNFNHEFLKFLRKVSRFEDINYDAMLKFLGDIQIKLSRSIRDEFPP

SEQ ID NO: 3391390 - protein, 33 aa, Plasmodium falciparum
NVNSNETEVFYYAKLMFPYLKDEIKENIDIYVD

SEQ ID NO: 3391391 - protein, 17 aa, Plasmodium falciparum
NVNVLLAGLLRYDPNKD

SEQ ID NO: 3391392 - protein, 26 aa, Plasmodium falciparum
NVPGTFPPDFLLMNAHKYVNSQPVPM

SEQ ID NO: 3391393 - protein, 29 aa, Plasmodium falciparum
NVPQINNEYIYYYLNKYISKNMNISDSTM

SEQ ID NO: 3391394 - protein, 23 aa, Plasmodium falciparum
NVQNLLNNPAFKTLLDQFKVYQE

SEQ ID NO: 3391395 - protein, 29 aa, Plasmodium falciparum
NVQSLNFEWNYLFFQSLNNLPQCCIDKIA

SEQ ID NO: 3391396 - protein, 20 aa, Plasmodium falciparum
NVRIDYLANILFHLNKDSNE

SEQ ID NO: 3391397 - protein, 39 aa, Plasmodium falciparum
NVRIIIKEWYIDYVLYPNSIPYIYVISTNNNRYRLDKPL

SEQ ID NO: 3391398 - protein, 19 aa, Plasmodium falciparum
NVSAEFWKVLVSAFSDGEK

SEQ ID NO: 3391399 - protein, 25 aa, Plasmodium falciparum
NVSDITILENKKLLNILNINNNIEN

SEQ ID NO: 3391400 - protein, 30 aa, Plasmodium falciparum
NVSKKVKLLAFLIMPYVWQGNSYISSNKLR

SEQ ID NO: 3391401 - protein, 32 aa, Plasmodium falciparum
NVSLIRDRIEREWRVEWLENGVPMKARWSCKK

SEQ ID NO: 3391402 - protein, 26 aa, Plasmodium falciparum
NVSTQPIISFDWCKDKLGLSVMASLD

SEQ ID NO: 3391403 - protein, 24 aa, Plasmodium falciparum
NVTCKVCYTVFMQTQSISQLAEHA

SEQ ID NO: 3391404 - protein, 26 aa, Plasmodium falciparum
NVTDIQLTYHFVCKEHDTCEGSVIVI

SEQ ID NO: 3391405 - protein, 21 aa, Plasmodium falciparum
NVTLLFRANLMEIFEKIKGRV

SEQ ID NO: 3391406 - protein, 18 aa, Plasmodium falciparum
NVTNIVDLKFKNPFINEE

SEQ ID NO: 3391407 - protein, 24 aa, Plasmodium falciparum
NVTRFILICNYIHKISDPIFSRCS

SEQ ID NO: 3391408 - protein, 22 aa, Plasmodium falciparum
NVVCKLCRHSFMCTVNQSILKE

SEQ ID NO: 3391409 - protein, 19 aa, Plasmodium falciparum
NVVRNVLLCLLIHNIVDVN

SEQ ID NO: 3391410 - protein, 25 aa, Plasmodium falciparum
NVVTWEDFSLFGKSKAPISENDYFK

SEQ ID NO: 3391411 - protein, 20 aa, Plasmodium falciparum
NVWKEWLQRINKHPFIYHFI

SEQ ID NO: 3391412 - protein, 19 aa, Plasmodium falciparum
NVYFDRFFYNKDTILKIKV

SEQ ID NO: 3391413 - protein, 18 aa, Plasmodium falciparum
NWAPFLTSAKKIKNLSRA

SEQ ID NO: 3391414 - protein, 36 aa, Plasmodium falciparum
NWDNHLRDYMLYSLSKNHYTFLRKNTLSKDIPMHSD

SEQ ID NO: 3391415 - protein, 18 aa, Plasmodium falciparum
NWDPLFFEKKYQHYKKED

SEQ ID NO: 3391416 - protein, 26 aa, Plasmodium falciparum
NWKLCCEKIFSLSIWPKFPDKEKVQN

SEQ ID NO: 3391417 - protein, 23 aa, Plasmodium falciparum
NWLNEFKSWLPQANVVCYHGNAV

SEQ ID NO: 3391418 - protein, 27 aa, Plasmodium falciparum
NWPYNLREFILKPRPLGLGLQPKQCIV

SEQ ID NO: 3391419 - protein, 27 aa, Plasmodium falciparum
NWRLRYSMYYCLKFFDHYFFFQNKENI

SEQ ID NO: 3391420 - protein, 22 aa, Plasmodium falciparum
NYAIYVLRVAKLLNFKANDLLM

SEQ ID NO: 3391421 - protein, 24 aa, Plasmodium falciparum
NYAKRFFPHHYNAGGFFIAVIQKG

SEQ ID NO: 3391422 - protein, 27 aa, Plasmodium falciparum
NYALSDMYALNIFTFSWFEVDISTSKN

SEQ ID NO: 3391423 - protein, 29 aa, Plasmodium falciparum
NYCVKIFAEAFYIIPKILARNAGYNTTDV

SEQ ID NO: 3391424 - protein, 20 aa, Plasmodium falciparum
NYDDKLSYASLYASNNRKKN

SEQ ID NO: 3391425 - protein, 23 aa, Plasmodium falciparum
NYDDPFFEYILNVDNNLYNDYKK

SEQ ID NO: 3391426 - protein, 25 aa, Plasmodium falciparum
NYDEHVTNYLKKGKLFYGKMKNKET

SEQ ID NO: 3391427 - protein, 26 aa, Plasmodium falciparum
NYDKKSFFYLHNIKQNIIQCKLNNIS

SEQ ID NO: 3391428 - protein, 37 aa, Plasmodium falciparum
NYDNVSYFCFTMYKIYLRRILFGYLRIRDNRINIKNV

SEQ ID NO: 3391429 - protein, 25 aa, Plasmodium falciparum
NYDQQIFYICKKIQKKLLQSYYTNT

SEQ ID NO: 3391430 - protein, 22 aa, Plasmodium falciparum
NYDTIKLLCLPTIYISSFVFYS

SEQ ID NO: 3391431 - protein, 32 aa, Plasmodium falciparum
NYDTKNYNIKLGWWNFGKPLKIFSNIEKYKQN

SEQ ID NO: 3391432 - protein, 21 aa, Plasmodium falciparum
NYDVLRLSLLYSLKYADEQHI

SEQ ID NO: 3391433 - protein, 27 aa, Plasmodium falciparum
NYEEKIVLDWRLPIGVLFDIYCDLDKS

SEQ ID NO: 3391434 - protein, 25 aa, Plasmodium falciparum
NYEENIIRVFLDILTKHDIKMDAKE

SEQ ID NO: 3391435 - protein, 44 aa, Plasmodium falciparum
NYEIKAYSCFYIYHKNLFLKYNIPFFTIFSQTSHFLVAKFNYNT

SEQ ID NO: 3391436 - protein, 24 aa, Plasmodium falciparum
NYEKYGSFLFNNHEEISFSTSCSN

SEQ ID NO: 3391437 - protein, 20 aa, Plasmodium falciparum
NYEKYYNYKLNNNLFKSDVN

SEQ ID NO: 3391438 - protein, 25 aa, Plasmodium falciparum
NYENINILLLILYTERDYYMHCDNN

SEQ ID NO: 3391439 - protein, 24 aa, Plasmodium falciparum
NYENNRSLSYFYSKKNYNEHFMPV

SEQ ID NO: 3391440 - protein, 18 aa, Plasmodium falciparum
NYESVEHYFIYSVIWCFG

SEQ ID NO: 3391441 - protein, 26 aa, Plasmodium falciparum
NYETLRDLFYIFYDIEILKIQNKQKH

SEQ ID NO: 3391442 - protein, 20 aa, Plasmodium falciparum
NYETNLIKRLFMEENNYNHC

SEQ ID NO: 3391443 - protein, 44 aa, Plasmodium falciparum
NYETTNIWLLHNKMLIKLLKKRKIILLKAPIFTKIHKENKTFIY

SEQ ID NO: 3391444 - protein, 19 aa, Plasmodium falciparum
NYEYYKFREIALKVITHLN

SEQ ID NO: 3391445 - protein, 21 aa, Plasmodium falciparum
NYFHKKKLRLVERWNRVAQES

SEQ ID NO: 3391446 - protein, 17 aa, Plasmodium falciparum
NYFIFYKYIINKLINHS

SEQ ID NO: 3391447 - protein, 18 aa, Plasmodium falciparum
NYFNKRILKPIQSFGYRG

SEQ ID NO: 3391448 - protein, 24 aa, Plasmodium falciparum
NYFNLNMNFLTIKNNLYIHLKDNG

SEQ ID NO: 3391449 - protein, 24 aa, Plasmodium falciparum
NYFNSQLDYLKRKFSNYRKNKEEE

SEQ ID NO: 3391450 - protein, 18 aa, Plasmodium falciparum
NYGIALELPQRKNRGKNM

SEQ ID NO: 3391451 - protein, 34 aa, Plasmodium falciparum
NYGNDIKMKILPPYMHHFNKAMKIIPEGSSCNVM

SEQ ID NO: 3391452 - protein, 31 aa, Plasmodium falciparum
NYGNMYYNEFNSSILFSIPPDDMYVARQNVD

SEQ ID NO: 3391453 - protein, 31 aa, Plasmodium falciparum
NYHDDYCFYITDLCKKGTMLSLKKNELFNQK

SEQ ID NO: 3391454 - protein, 20 aa, Plasmodium falciparum
NYHKDSDLFLYKNESGLGKR

SEQ ID NO: 3391455 - protein, 25 aa, Plasmodium falciparum
NYHKNYYIIEFKNILYNEKKKFNNL

SEQ ID NO: 3391456 - protein, 25 aa, Plasmodium falciparum
NYIAQIIELLPQYINDIHIKPGMMN

SEQ ID NO: 3391457 - protein, 24 aa, Plasmodium falciparum
NYIFKNKRSLLNYKYYNSKDYSVK

SEQ ID NO: 3391458 - protein, 21 aa, Plasmodium falciparum
NYIKHMEDIIYLKCLDKLKFL

SEQ ID NO: 3391459 - protein, 20 aa, Plasmodium falciparum
NYIKKIRQSFQKRKFMTADE

SEQ ID NO: 3391460 - protein, 22 aa, Plasmodium falciparum
NYILLNSNHILLKKLFGYMDVV

SEQ ID NO: 3391461 - protein, 26 aa, Plasmodium falciparum
NYINLHKSFIRYPIIFDKYYNNYQKK

SEQ ID NO: 3391462 - protein, 30 aa, Plasmodium falciparum
NYINNLLVYIHFIVFKYITLYSINEWNVLL

SEQ ID NO: 3391463 - protein, 24 aa, Plasmodium falciparum
NYINYGPIYAPDGSTIYTWVNNID

SEQ ID NO: 3391464 - protein, 22 aa, Plasmodium falciparum
NYIQHMLFIGGPQNQWIPYQYR

SEQ ID NO: 3391465 - protein, 35 aa, Plasmodium falciparum
NYIRINLFDACNCLYYLNPSFIKKVSKKFTNFFLE

SEQ ID NO: 3391466 - protein, 31 aa, Plasmodium falciparum
NYISTCFNAFYNFFYFIQIQCPQAIHTDLVP

SEQ ID NO: 3391467 - protein, 24 aa, Plasmodium falciparum
NYITYYVMNILDTKPKSILDNENF

SEQ ID NO: 3391468 - protein, 18 aa, Plasmodium falciparum
NYIYELEKKLIFEKEKNK

SEQ ID NO: 3391469 - protein, 21 aa, Plasmodium falciparum
NYIYIIKYKNFYHNLLNIEFF

SEQ ID NO: 3391470 - protein, 32 aa, Plasmodium falciparum
NYKCDMWSSGVLFYILLCGYPPFFGESDHEIL

SEQ ID NO: 3391471 - protein, 23 aa, Plasmodium falciparum
NYKDFLNVINKRMINFTKDNNSN

SEQ ID NO: 3391472 - protein, 69 aa, Plasmodium falciparum
NYKGKDKVMIYFLNPGFQKRLLEAYSNIFLHFDIFIDNKTYNFIFNNCEYVNVLLYRAFSIKREDEYNR

SEQ ID NO: 3391473 - protein, 17 aa, Plasmodium falciparum
NYKGPELFILQGMIFLK

SEQ ID NO: 3391474 - protein, 20 aa, Plasmodium falciparum
NYKILFLCLQEIFNDKNIHD

SEQ ID NO: 3391475 - protein, 25 aa, Plasmodium falciparum
NYKIYAYYAIIQFIFHILQNNDEQA

SEQ ID NO: 3391476 - protein, 17 aa, Plasmodium falciparum
NYKKYYIDQLKENIKKI

SEQ ID NO: 3391477 - protein, 28 aa, Plasmodium falciparum
NYKMKYKIFKKSVLYSNYYGPDIIHLFN

SEQ ID NO: 3391478 - protein, 24 aa, Plasmodium falciparum
NYKSSNYYKYSSKGSFYKDTKTSS

SEQ ID NO: 3391479 - protein, 17 aa, Plasmodium falciparum
NYKVVETYKSSFKVQEE

SEQ ID NO: 3391480 - protein, 23 aa, Plasmodium falciparum
NYKYRNYRNYERSNYVIGELQSQ

SEQ ID NO: 3391481 - protein, 18 aa, Plasmodium falciparum
NYKYYRNTCISIHFILFS

SEQ ID NO: 3391482 - protein, 33 aa, Plasmodium falciparum
NYLHSNFQWDKNLALKIWAFGPETIGPNLLTDN

SEQ ID NO: 3391483 - protein, 28 aa, Plasmodium falciparum
NYLIHSINIFILLLKKNNFDFISSIYLS

SEQ ID NO: 3391484 - protein, 17 aa, Plasmodium falciparum
NYLKYFTDEINWFSEFF

SEQ ID NO: 3391485 - protein, 19 aa, Plasmodium falciparum
NYLLCFNSHNLLYSNNNSL

SEQ ID NO: 3391486 - protein, 21 aa, Plasmodium falciparum
NYLLHFLKEDKTKFFQFLLML

SEQ ID NO: 3391487 - protein, 30 aa, Plasmodium falciparum
NYLMHDLNWYTFLFLFRMTTYKDIPNYSIS

SEQ ID NO: 3391488 - protein, 23 aa, Plasmodium falciparum
NYLNGYFISFNMYYLPHIENDSN

SEQ ID NO: 3391489 - protein, 35 aa, Plasmodium falciparum
NYLQKNEMFFNMNDIFYPFTIKNFNLCKNKNEKNK

SEQ ID NO: 3391490 - protein, 18 aa, Plasmodium falciparum
NYMISFFEKINVLVDCKT

SEQ ID NO: 3391491 - protein, 22 aa, Plasmodium falciparum
NYNDLLKQLMLSELRTVLDNLE

SEQ ID NO: 3391492 - protein, 18 aa, Plasmodium falciparum
NYNFEKFMNFINPEFYGK

SEQ ID NO: 3391493 - protein, 21 aa, Plasmodium falciparum
NYNFLIQLLAKCISTLMPEKI

SEQ ID NO: 3391494 - protein, 22 aa, Plasmodium falciparum
NYNGDKLLYIKNPWGCIRWKGR

SEQ ID NO: 3391495 - protein, 20 aa, Plasmodium falciparum
NYNIHLHKMKFFEDAIIQII

SEQ ID NO: 3391496 - protein, 17 aa, Plasmodium falciparum
NYNIMYDEFLKDLKKYL

SEQ ID NO: 3391497 - protein, 22 aa, Plasmodium falciparum
NYNKENYLSPISFTGNICKIAK

SEQ ID NO: 3391498 - protein, 26 aa, Plasmodium falciparum
NYNKIYYQNSYYIVSNYYDCYGKDYY

SEQ ID NO: 3391499 - protein, 29 aa, Plasmodium falciparum
NYNKKKNIYLYPYLKFIKNELLEPYKDYR

SEQ ID NO: 3391500 - protein, 29 aa, Plasmodium falciparum
NYNKKNDCMFLFKDNLSISGLGNVNLCNE

SEQ ID NO: 3391501 - protein, 24 aa, Plasmodium falciparum
NYNLRYYFYHALSWPYLSQIAEDV

SEQ ID NO: 3391502 - protein, 18 aa, Plasmodium falciparum
NYNNLIKNRLDKLTKVPI

SEQ ID NO: 3391503 - protein, 29 aa, Plasmodium falciparum
NYNNVKRINSISHIPYMNNLKNYNEHTSM

SEQ ID NO: 3391504 - protein, 26 aa, Plasmodium falciparum
NYNPKKVKVFFFSKNNPTELLNFVDQ

SEQ ID NO: 3391505 - protein, 22 aa, Plasmodium falciparum
NYNYEEYLILSKTIKLHMKKSS

SEQ ID NO: 3391506 - protein, 20 aa, Plasmodium falciparum
NYNYIKKLILIFNCINQKVK

SEQ ID NO: 3391507 - protein, 20 aa, Plasmodium falciparum
NYNYNYNYNYAYDNIELSNK

SEQ ID NO: 3391508 - protein, 19 aa, Plasmodium falciparum
NYPIQYFCHTCLSLCFCSE

SEQ ID NO: 3391509 - protein, 29 aa, Plasmodium falciparum
NYPNTCPEVFFITPIFHPLVNIQTGKLNL

SEQ ID NO: 3391510 - protein, 17 aa, Plasmodium falciparum
NYPYFSLQCLKNISNEK

SEQ ID NO: 3391511 - protein, 23 aa, Plasmodium falciparum
NYQDFFRYMQPNYILEIMKRHII

SEQ ID NO: 3391512 - protein, 19 aa, Plasmodium falciparum
NYQGWAFGIGLERLCMLLY

SEQ ID NO: 3391513 - protein, 26 aa, Plasmodium falciparum
NYRKTIIHILPQLKQLDALPIPSSPT

SEQ ID NO: 3391514 - protein, 18 aa, Plasmodium falciparum
NYSIYNDYIYIYCKEGIK

SEQ ID NO: 3391515 - protein, 20 aa, Plasmodium falciparum
NYSMNKINPISIISQVKIMD

SEQ ID NO: 3391516 - protein, 25 aa, Plasmodium falciparum
NYSNFKYHYNYYLVDEYLESLVESQ

SEQ ID NO: 3391517 - protein, 34 aa, Plasmodium falciparum
NYSNNLRNGFTSIWFPLIYLKPVEEENKRDAELM

SEQ ID NO: 3391518 - protein, 19 aa, Plasmodium falciparum
NYSRNFCYIKITFNKLGGM

SEQ ID NO: 3391519 - protein, 17 aa, Plasmodium falciparum
NYSSRFAILKKNLKFFK

SEQ ID NO: 3391520 - protein, 23 aa, Plasmodium falciparum
NYSTALTIKWAFEIKNQPHNLIQ

SEQ ID NO: 3391521 - protein, 21 aa, Plasmodium falciparum
NYSWIVKEVIAIIILVHGLGS

SEQ ID NO: 3391522 - protein, 18 aa, Plasmodium falciparum
NYSYNLYDLLKILELYQK

SEQ ID NO: 3391523 - protein, 24 aa, Plasmodium falciparum
NYTKRFIFLTSLYNNIFNYSYNLY

SEQ ID NO: 3391524 - protein, 17 aa, Plasmodium falciparum
NYTLFNKYNMTSDNLFF

SEQ ID NO: 3391525 - protein, 19 aa, Plasmodium falciparum
NYTLIYDFNFIYVDKEKKQ

SEQ ID NO: 3391526 - protein, 18 aa, Plasmodium falciparum
NYTLKDTKLINVLPNSIC

SEQ ID NO: 3391527 - protein, 25 aa, Plasmodium falciparum
NYTNEKVCCNYLNNNVYNNYCYDNN

SEQ ID NO: 3391528 - protein, 27 aa, Plasmodium falciparum
NYTNYIEQDLFLNELPFQYGCSDSIEY

SEQ ID NO: 3391529 - protein, 33 aa, Plasmodium falciparum
NYTSFILNDFIFFRKFFLIYNMDKLLSNRKNIH

SEQ ID NO: 3391530 - protein, 25 aa, Plasmodium falciparum
NYTTNTMWRYMGSTAKFRLVEDQQE

SEQ ID NO: 3391531 - protein, 22 aa, Plasmodium falciparum
NYTVKILPYFYNISYNMIMNKL

SEQ ID NO: 3391532 - protein, 26 aa, Plasmodium falciparum
NYVDNVFIKILLLNIITKFSQLPCEA

SEQ ID NO: 3391533 - protein, 22 aa, Plasmodium falciparum
NYVDYNFKQIDYFCLSFLNKEK

SEQ ID NO: 3391534 - protein, 24 aa, Plasmodium falciparum
NYVGSPNFIPPEALINKCSGKARD

SEQ ID NO: 3391535 - protein, 23 aa, Plasmodium falciparum
NYVIDTSIIYCNSGYYPKPSLFQ

SEQ ID NO: 3391536 - protein, 55 aa, Plasmodium falciparum
NYVKNEIINLYKQNPIQLLTLQKCLSLIKANRNIIEVMFYILENNKLINMQCDPQ

SEQ ID NO: 3391537 - protein, 25 aa, Plasmodium falciparum
NYVKNNYIYSAILIYNPNISNKHNI

SEQ ID NO: 3391538 - protein, 36 aa, Plasmodium falciparum
NYVKNVIIYDVYYEGFIPFFRPILNLKSKKNQDKIQ

SEQ ID NO: 3391539 - protein, 19 aa, Plasmodium falciparum
NYVNKKYSFIKIIKKEKKK

SEQ ID NO: 3391540 - protein, 27 aa, Plasmodium falciparum
NYVNYTFIDFLFDPYTYSSNIFNLICS

SEQ ID NO: 3391541 - protein, 20 aa, Plasmodium falciparum
NYVYSRLRSNRPAPWFGQRD

SEQ ID NO: 3391542 - protein, 21 aa, Plasmodium falciparum
NYYDVNFGDPWLYISWNMKRT

SEQ ID NO: 3391543 - protein, 19 aa, Plasmodium falciparum
NYYKDLPTVIIVIGMAGSG

SEQ ID NO: 3391544 - protein, 28 aa, Plasmodium falciparum
NYYNNKQQFLFSTLSKQYNTNVNISFAN

SEQ ID NO: 3391545 - protein, 20 aa, Plasmodium falciparum
NYYNTMNMIGYMDKINNMNN

SEQ ID NO: 3391546 - protein, 18 aa, Plasmodium falciparum
NYYSFMINDKLPIKNSLY

SEQ ID NO: 3391547 - protein, 18 aa, Plasmodium falciparum
PAAYYIWECVQAFFNKEI

SEQ ID NO: 3391548 - protein, 21 aa, Plasmodium falciparum
PAFMGIGCLPIYDAYDISKVD

SEQ ID NO: 3391549 - protein, 30 aa, Plasmodium falciparum
PAKAPTILRWIDLLRSMKLKQLKKSIDEEL

SEQ ID NO: 3391550 - protein, 18 aa, Plasmodium falciparum
PAKPLSLELLYPNGTEEP

SEQ ID NO: 3391551 - protein, 26 aa, Plasmodium falciparum
PAKSKFIELLKDIKILKGQAIIFVEL

SEQ ID NO: 3391552 - protein, 26 aa, Plasmodium falciparum
PALLRPGRLDRKIEFPLPDRKQKRLI

SEQ ID NO: 3391553 - protein, 27 aa, Plasmodium falciparum
PAPARLGVIAPIDVFIPPGPTGMDPSH

SEQ ID NO: 3391554 - protein, 25 aa, Plasmodium falciparum
PASLILTCIPIPPPCARPYVQYGNQ

SEQ ID NO: 3391555 - protein, 26 aa, Plasmodium falciparum
PAWSAKKNFLKLLKKNNVLIIVGDTG

SEQ ID NO: 3391556 - protein, 29 aa, Plasmodium falciparum
PCDNKKVFIYFIPIIGIAPEWCNFLDSIT

SEQ ID NO: 3391557 - protein, 30 aa, Plasmodium falciparum
PCEHYLSVASVLCLENRKIIGCIINVNSNE

SEQ ID NO: 3391558 - protein, 22 aa, Plasmodium falciparum
PCENYFKKQCKRSMPVCIYCHD

SEQ ID NO: 3391559 - protein, 38 aa, Plasmodium falciparum
PCKDIKEIMLKYVYCTTFFDNYILSIKNELEKYGLDIN

SEQ ID NO: 3391560 - protein, 18 aa, Plasmodium falciparum
PCKYEWTRGCHLGSRCRF

SEQ ID NO: 3391561 - protein, 17 aa, Plasmodium falciparum
PCLYPPKIMPKVVTQYV

SEQ ID NO: 3391562 - protein, 46 aa, Plasmodium falciparum
PCNKLFDHLKLLYFVKSKYLWKARIFFIWQRLFTSSNDYYYSLKIN

SEQ ID NO: 3391563 - protein, 17 aa, Plasmodium falciparum
PCNMPMNNLSKYIYYWI

SEQ ID NO: 3391564 - protein, 18 aa, Plasmodium falciparum
PCNNKIYRKNKIGDNNMS

SEQ ID NO: 3391565 - protein, 24 aa, Plasmodium falciparum
PCPKLPPCYIINSGSLSIARAKVK

SEQ ID NO: 3391566 - protein, 24 aa, Plasmodium falciparum
PCRDINCTFAHDIDTLKPSVHLAT

SEQ ID NO: 3391567 - protein, 17 aa, Plasmodium falciparum
PCSYIDIIINIIEEYLP

SEQ ID NO: 3391568 - protein, 22 aa, Plasmodium falciparum
PCYEYNILQGLNKPIFNSNCEN

SEQ ID NO: 3391569 - protein, 28 aa, Plasmodium falciparum
PDADMKPPENILFVCKLNPVTEEEDLKI

SEQ ID NO: 3391570 - protein, 30 aa, Plasmodium falciparum
PDCFAEIEISYYLLRRLLGVKSQDGEKNTK

SEQ ID NO: 3391571 - protein, 18 aa, Plasmodium falciparum
PDDIGIISLYRSQSSYIR

SEQ ID NO: 3391572 - protein, 20 aa, Plasmodium falciparum
PDEAPLYKIVDVKNLSISLI

SEQ ID NO: 3391573 - protein, 21 aa, Plasmodium falciparum
PDEEIYFCITNFSLKKVLNDL

SEQ ID NO: 3391574 - protein, 28 aa, Plasmodium falciparum
PDFLIKYYEWEELPSFYNLPYGLINKKN

SEQ ID NO: 3391575 - protein, 24 aa, Plasmodium falciparum
PDGAEVFFKIKRKTKLEKLMEVYC

SEQ ID NO: 3391576 - protein, 18 aa, Plasmodium falciparum
PDICHTFFGLAALSLIDN

SEQ ID NO: 3391577 - protein, 25 aa, Plasmodium falciparum
PDKKYQYLLFAAEPYETIAFKIPNI

SEQ ID NO: 3391578 - protein, 23 aa, Plasmodium falciparum
PDKLRPDIWPYLLDSMVLCLKYP

SEQ ID NO: 3391579 - protein, 22 aa, Plasmodium falciparum
PDLFHNVYFLCAHYTILNKEIN

SEQ ID NO: 3391580 - protein, 27 aa, Plasmodium falciparum
PDLRDRAYIYWRLLSKNIDVAKKIVLA

SEQ ID NO: 3391581 - protein, 26 aa, Plasmodium falciparum
PDNCEKWFEPVLLNLLKRILDSNKRV

SEQ ID NO: 3391582 - protein, 26 aa, Plasmodium falciparum
PDYDYKDELYNRKLKLVPLEEYEDKE

SEQ ID NO: 3391583 - protein, 53 aa, Plasmodium falciparum
PEANYVKIWQTQILVKVIEYLKINFIKKYETIPSLIICGDFNSTPSSAVYQLI

SEQ ID NO: 3391584 - protein, 24 aa, Plasmodium falciparum
PEDKHKWYISFKKAQLNYINGNNY

SEQ ID NO: 3391585 - protein, 67 aa, Plasmodium falciparum
PEDLKCDVAGVYWDKRSWIASWYDNGKRYYKSFSAKTHGFYKSKFWAIKVRLSKVKGQTIFGKNSRK

SEQ ID NO: 3391586 - protein, 25 aa, Plasmodium falciparum
PEDMYSIYFPIVNFVQILSLKNVKN

SEQ ID NO: 3391587 - protein, 24 aa, Plasmodium falciparum
PEFERSLYLYGPSRSLSFANVMKA

SEQ ID NO: 3391588 - protein, 27 aa, Plasmodium falciparum
PEFHSYVVFKIFFSIKENLDQYALIQV

SEQ ID NO: 3391589 - protein, 19 aa, Plasmodium falciparum
PEFLKPIICRSACSSNFLG

SEQ ID NO: 3391590 - protein, 18 aa, Plasmodium falciparum
PEFSKKMKYTKLYQKENM

SEQ ID NO: 3391591 - protein, 26 aa, Plasmodium falciparum
PEGLKMKLGFFIKKHSNVFKFDTEGQ

SEQ ID NO: 3391592 - protein, 42 aa, Plasmodium falciparum
PEIINQIPYDCNVDLWCLGIVIFELLVGFPPFTDDTQERIFD

SEQ ID NO: 3391593 - protein, 27 aa, Plasmodium falciparum
PEIKKKEFFNYNNYMKWFTKHMKKRKS

SEQ ID NO: 3391594 - protein, 19 aa, Plasmodium falciparum
PEIPINIFSVVHLYMRKKK

SEQ ID NO: 3391595 - protein, 24 aa, Plasmodium falciparum
PEKLISTKNIKLLSLHRPNTIEDI

SEQ ID NO: 3391596 - protein, 21 aa, Plasmodium falciparum
PEKQFVPIRLNSAKTLLKVIN

SEQ ID NO: 3391597 - protein, 27 aa, Plasmodium falciparum
PEKSLYFYIHILGMKLIHVKHCSDFSL

SEQ ID NO: 3391598 - protein, 18 aa, Plasmodium falciparum
PELFILQGMIFLKMKRNV

SEQ ID NO: 3391599 - protein, 17 aa, Plasmodium falciparum
PELLKIDNFKIIHKNIY

SEQ ID NO: 3391600 - protein, 26 aa, Plasmodium falciparum
PELMDDFYLNLLDWSKKNIIATALCD

SEQ ID NO: 3391601 - protein, 22 aa, Plasmodium falciparum
PELNSDLPDYLIPTLELEENQN

SEQ ID NO: 3391602 - protein, 26 aa, Plasmodium falciparum
PELTDKMFFYYKLLSYNYKEAFHIIA

SEQ ID NO: 3391603 - protein, 18 aa, Plasmodium falciparum
PENVLVSPLTTIPKPKDY

SEQ ID NO: 3391604 - protein, 24 aa, Plasmodium falciparum
PERIIDNRVVFLHFAVSQNLKKYQ

SEQ ID NO: 3391605 - protein, 28 aa, Plasmodium falciparum
PESDHLTLLNIYLQWRSHNYSYSWCTKN

SEQ ID NO: 3391606 - protein, 18 aa, Plasmodium falciparum
PESLIKIIDFGLASYFTH

SEQ ID NO: 3391607 - protein, 18 aa, Plasmodium falciparum
PEVLLQQNYDRKIDIWSL

SEQ ID NO: 3391608 - protein, 33 aa, Plasmodium falciparum
PEVVLKFMKVSLHLLLFRFLCLDKETGDITIPG

SEQ ID NO: 3391609 - protein, 27 aa, Plasmodium falciparum
PEYKRDILYVFKRLYVDKCFIPNMNPK

SEQ ID NO: 3391610 - protein, 18 aa, Plasmodium falciparum
PFDHGHYKNFILKKNNKN

SEQ ID NO: 3391611 - protein, 24 aa, Plasmodium falciparum
PFECVQKLLADGCKRMAIIKEECG

SEQ ID NO: 3391612 - protein, 17 aa, Plasmodium falciparum
PFERHKLMMSLRSLEEE

SEQ ID NO: 3391613 - protein, 31 aa, Plasmodium falciparum
PFEWQHDVRQIFFNAFTYHKVKNCVWNDAYK

SEQ ID NO: 3391614 - protein, 20 aa, Plasmodium falciparum
PFGQKLLRDIFLKTDNYIEG

SEQ ID NO: 3391615 - protein, 26 aa, Plasmodium falciparum
PFINIKPFFMLKDSYDSICIPCIKFK

SEQ ID NO: 3391616 - protein, 20 aa, Plasmodium falciparum
PFIPKVLEYLIKLLNDEKPL

SEQ ID NO: 3391617 - protein, 25 aa, Plasmodium falciparum
PFIQRIVCVLIKKFLCEHLSEEFVY

SEQ ID NO: 3391618 - protein, 28 aa, Plasmodium falciparum
PFKGTKNKLSLFYNKNSINNIKNSMLLL

SEQ ID NO: 3391619 - protein, 17 aa, Plasmodium falciparum
PFKTSMLATASWDGTIK

SEQ ID NO: 3391620 - protein, 19 aa, Plasmodium falciparum
PFLVNYVRKYGTFSRAFIV

SEQ ID NO: 3391621 - protein, 21 aa, Plasmodium falciparum
PFSFNFYEHGNIKIIDRLKEL

SEQ ID NO: 3391622 - protein, 22 aa, Plasmodium falciparum
PFSGPQPTLPQAPFAASQGKVG

SEQ ID NO: 3391623 - protein, 24 aa, Plasmodium falciparum
PFSNKKINFKYFIMNDKKKDKSCK

SEQ ID NO: 3391624 - protein, 21 aa, Plasmodium falciparum
PFSSYYRPQAYIRTADVNCAV

SEQ ID NO: 3391625 - protein, 19 aa, Plasmodium falciparum
PFVCDVNGWSFVKGNIKYY

SEQ ID NO: 3391626 - protein, 20 aa, Plasmodium falciparum
PFYFYNIYPDENEKMFYCIL

SEQ ID NO: 3391627 - protein, 21 aa, Plasmodium falciparum
PFYPIYMSCQYFHIKDTNKYF

SEQ ID NO: 3391628 - protein, 23 aa, Plasmodium falciparum
PGELYNRILKCYEKLDFMITNLN

SEQ ID NO: 3391629 - protein, 23 aa, Plasmodium falciparum
PGGKLTIHVVKKKAGKPKCADCK

SEQ ID NO: 3391630 - protein, 27 aa, Plasmodium falciparum
PGLANQYNYSYGNLSYPYNNMPYNGYT

SEQ ID NO: 3391631 - protein, 25 aa, Plasmodium falciparum
PGNLGEFLPKFLIDNNINSGNNVVS

SEQ ID NO: 3391632 - protein, 20 aa, Plasmodium falciparum
PGQIEVFNWSASGNIILETL

SEQ ID NO: 3391633 - protein, 26 aa, Plasmodium falciparum
PGRTRHLFIFNLLNYLSIVDLPGYGY

SEQ ID NO: 3391634 - protein, 43 aa, Plasmodium falciparum
PGVATDPRLHFIKRKILFMMQLWHDSFILHQHICTAIFAEYKS

SEQ ID NO: 3391635 - protein, 21 aa, Plasmodium falciparum
PHAPKRSLSAYMFFAKEKRAE

SEQ ID NO: 3391636 - protein, 17 aa, Plasmodium falciparum
PHECAFPITLIYGNKDT

SEQ ID NO: 3391637 - protein, 18 aa, Plasmodium falciparum
PHFLFTVLKELEISKYIK

SEQ ID NO: 3391638 - protein, 19 aa, Plasmodium falciparum
PHIFTKHGLIILKKFTTDN

SEQ ID NO: 3391639 - protein, 18 aa, Plasmodium falciparum
PHLRKAAGIVWKDPTLDE

SEQ ID NO: 3391640 - protein, 29 aa, Plasmodium falciparum
PHNLSFAQYTLIEIFKIALYDNLKNNIFW

SEQ ID NO: 3391641 - protein, 26 aa, Plasmodium falciparum
PHNQEFRVRYRYKGSMRLKTISCKHF

SEQ ID NO: 3391642 - protein, 26 aa, Plasmodium falciparum
PHSSVSLSHLLFVKAENNNIGVVDCG

SEQ ID NO: 3391643 - protein, 33 aa, Plasmodium falciparum
PHTITIQFIKFLKISKIYLLLNYYLDESYTPHD

SEQ ID NO: 3391644 - protein, 21 aa, Plasmodium falciparum
PIADFINSFYLNIHNINIGKK

SEQ ID NO: 3391645 - protein, 17 aa, Plasmodium falciparum
PICGSSKSPLNIQNNNI

SEQ ID NO: 3391646 - protein, 22 aa, Plasmodium falciparum
PIDKIIPRSFSKSLSIPMKVPT

SEQ ID NO: 3391647 - protein, 25 aa, Plasmodium falciparum
PIDVLRWLDRKLIRLVSTFADYQKD

SEQ ID NO: 3391648 - protein, 29 aa, Plasmodium falciparum
PIERLNRVTNYLYYKKALKKYNKHGKEQN

SEQ ID NO: 3391649 - protein, 25 aa, Plasmodium falciparum
PIGCAPIAHILWSYVMNYYNEDTKW

SEQ ID NO: 3391650 - protein, 17 aa, Plasmodium falciparum
PIHCEWLKRILENFFFI

SEQ ID NO: 3391651 - protein, 26 aa, Plasmodium falciparum
PIICYKCLSFFECENNYNFIRCPKCK

SEQ ID NO: 3391652 - protein, 29 aa, Plasmodium falciparum
PIIFDGFVNYIMYLFKHINLLTKNNFSIT

SEQ ID NO: 3391653 - protein, 31 aa, Plasmodium falciparum
PIIISSHIIPPPPPTFKPPPPPPPKEKNKIE

SEQ ID NO: 3391654 - protein, 20 aa, Plasmodium falciparum
PIKFEKLYTSHIYNEKKGNI

SEQ ID NO: 3391655 - protein, 18 aa, Plasmodium falciparum
PIKKLTEAYYILFSFEIY

SEQ ID NO: 3391656 - protein, 24 aa, Plasmodium falciparum
PIKSSYFQIPYMSFKKFNVIKNGA

SEQ ID NO: 3391657 - protein, 17 aa, Plasmodium falciparum
PILIYPNDIYEYTNLKT

SEQ ID NO: 3391658 - protein, 17 aa, Plasmodium falciparum
PILKNEKIKNIYPIVPY

SEQ ID NO: 3391659 - protein, 18 aa, Plasmodium falciparum
PILLKYNNYRKLFIYKLK

SEQ ID NO: 3391660 - protein, 25 aa, Plasmodium falciparum
PIMNQLNLFHKWLDRHRYICEKWKH

SEQ ID NO: 3391661 - protein, 24 aa, Plasmodium falciparum
PINDLIDWNVINKIKNPLSNSYNE

SEQ ID NO: 3391662 - protein, 56 aa, Plasmodium falciparum
PINNTVPVVVNWVQCELCKKWRKLDAHINISLLPEKWYCSLNFWNAYNNCDMEEEI

SEQ ID NO: 3391663 - protein, 21 aa, Plasmodium falciparum
PINPETWRWYYNVVGKKKCTI

SEQ ID NO: 3391664 - protein, 17 aa, Plasmodium falciparum
PINYKKVSSKKRSYKKD

SEQ ID NO: 3391665 - protein, 17 aa, Plasmodium falciparum
PIPIDKITYELSQNIIL

SEQ ID NO: 3391666 - protein, 24 aa, Plasmodium falciparum
PIPLESYPYYHYYYSNVHTKKEPK

SEQ ID NO: 3391667 - protein, 25 aa, Plasmodium falciparum
PIPNGLHISIYIPQSYDFTDEVKDQ

SEQ ID NO: 3391668 - protein, 19 aa, Plasmodium falciparum
PIRKKIIPVIKYTDNIIYV

SEQ ID NO: 3391669 - protein, 29 aa, Plasmodium falciparum
PITNQQYFYPLIPQYPFATTAYNPNINYP

SEQ ID NO: 3391670 - protein, 26 aa, Plasmodium falciparum
PIYIKKKFISILFYFKGHGRKEKIQL

SEQ ID NO: 3391671 - protein, 20 aa, Plasmodium falciparum
PIYKISKLCKFLVKGTCHKQ

SEQ ID NO: 3391672 - protein, 18 aa, Plasmodium falciparum
PIYSLLQIKNLIDNDILQ

SEQ ID NO: 3391673 - protein, 24 aa, Plasmodium falciparum
PKAARIPSFYPKINMNNSMFNYHE

SEQ ID NO: 3391674 - protein, 30 aa, Plasmodium falciparum
PKDKREHISKNPFPSPLTIRTYLSKRHHNS

SEQ ID NO: 3391675 - protein, 19 aa, Plasmodium falciparum
PKDLSYINSQLSPFELKPV

SEQ ID NO: 3391676 - protein, 33 aa, Plasmodium falciparum
PKENEAFLKDMDYFFEKTDTLDLLNKKIYDYEN

SEQ ID NO: 3391677 - protein, 27 aa, Plasmodium falciparum
PKEQPYNNVPYILKKGLEPKTHNHVKE

SEQ ID NO: 3391678 - protein, 21 aa, Plasmodium falciparum
PKGIRLPCKLKWTVDNNSMVS

SEQ ID NO: 3391679 - protein, 27 aa, Plasmodium falciparum
PKIARLRLYFIVSYLHAIILERRRYTP

SEQ ID NO: 3391680 - protein, 17 aa, Plasmodium falciparum
PKIHKRRGRRRKKDIEQ

SEQ ID NO: 3391681 - protein, 18 aa, Plasmodium falciparum
PKIIAMRLTYPETVNKYN

SEQ ID NO: 3391682 - protein, 26 aa, Plasmodium falciparum
PKKLKDFLIYFFRKNIEVLLITNEDI

SEQ ID NO: 3391683 - protein, 27 aa, Plasmodium falciparum
PKKNHRVWFHVILSRDIPIAIRFSCTF

SEQ ID NO: 3391684 - protein, 33 aa, Plasmodium falciparum
PKKRPYFYENVSSKITGFFFQVKKKINKNNDED

SEQ ID NO: 3391685 - protein, 27 aa, Plasmodium falciparum
PKKSDVFPSESFLSYFKRQPSSDNANN

SEQ ID NO: 3391686 - protein, 17 aa, Plasmodium falciparum
PKLLNFKTVLTASFPMS

SEQ ID NO: 3391687 - protein, 18 aa, Plasmodium falciparum
PKMIGEDNSYVIYKMNDE

SEQ ID NO: 3391688 - protein, 28 aa, Plasmodium falciparum
PKNIKKTFTSYFNNFIPSIFTSENKKEP

SEQ ID NO: 3391689 - protein, 32 aa, Plasmodium falciparum
PKNIPLGYDISFLDYKEWWNVVGSFRCSGVIN

SEQ ID NO: 3391690 - protein, 27 aa, Plasmodium falciparum
PKNLKFKLFEPFKYLFKDDVKTLSREL

SEQ ID NO: 3391691 - protein, 23 aa, Plasmodium falciparum
PKNNLKYPMNIYNKLFNKDRQNI

SEQ ID NO: 3391692 - protein, 18 aa, Plasmodium falciparum
PKNSILNLNFEIPKLNTF

SEQ ID NO: 3391693 - protein, 18 aa, Plasmodium falciparum
PKPSLFQLSKKHLNIIMK

SEQ ID NO: 3391694 - protein, 29 aa, Plasmodium falciparum
PKSIGKNTKNIFFKSNDWKCDDCGNINWA

SEQ ID NO: 3391695 - protein, 22 aa, Plasmodium falciparum
PKVIGIRLISTLKAIAFSMDSP

SEQ ID NO: 3391696 - protein, 18 aa, Plasmodium falciparum
PKVRSVFRLLRLLQVHNG

SEQ ID NO: 3391697 - protein, 20 aa, Plasmodium falciparum
PKWLWKLEKPLKSYGELALM

SEQ ID NO: 3391698 - protein, 17 aa, Plasmodium falciparum
PKYAIFNIWPKQCDING

SEQ ID NO: 3391699 - protein, 24 aa, Plasmodium falciparum
PKYASSPILTFLDNSYNRVMTIIE

SEQ ID NO: 3391700 - protein, 18 aa, Plasmodium falciparum
PKYGLIYHATLVGQTAPK

SEQ ID NO: 3391701 - protein, 18 aa, Plasmodium falciparum
PKYMINFDQIPFYQAYDT

SEQ ID NO: 3391702 - protein, 24 aa, Plasmodium falciparum
PKYYYELYMLIFNELQHLDNFISD

SEQ ID NO: 3391703 - protein, 25 aa, Plasmodium falciparum
PLAHHNRVPFLPAPAAPGTPDIENI

SEQ ID NO: 3391704 - protein, 28 aa, Plasmodium falciparum
PLAHIYERLMIYLFMAHGVKVGYYSGNV

SEQ ID NO: 3391705 - protein, 27 aa, Plasmodium falciparum
PLEIIKMIYKFLISKSLYKLNINILHD

SEQ ID NO: 3391706 - protein, 20 aa, Plasmodium falciparum
PLEINNITLNKLFDECPQCI

SEQ ID NO: 3391707 - protein, 18 aa, Plasmodium falciparum
PLFLLQQAKCLRTKKKKN

SEQ ID NO: 3391708 - protein, 29 aa, Plasmodium falciparum
PLGFDNKPIPYWLYKLHGLSKEYKCEICG

SEQ ID NO: 3391709 - protein, 27 aa, Plasmodium falciparum
PLHEKYCLLHYYDKILLHPGPSPLYNN

SEQ ID NO: 3391710 - protein, 17 aa, Plasmodium falciparum
PLIFSKINKLQKEKEDE

SEQ ID NO: 3391711 - protein, 20 aa, Plasmodium falciparum
PLILCLHKYNDDITKCVPEI

SEQ ID NO: 3391712 - protein, 17 aa, Plasmodium falciparum
PLITKLKKTIYAELLYI

SEQ ID NO: 3391713 - protein, 28 aa, Plasmodium falciparum
PLLFSNNIVLPNPFLPYVKDQNKKEAHT

SEQ ID NO: 3391714 - protein, 22 aa, Plasmodium falciparum
PLNFRYSIFLLNSKQYNCIYEV

SEQ ID NO: 3391715 - protein, 17 aa, Plasmodium falciparum
PLNILKKKSFNVTDRIG

SEQ ID NO: 3391716 - protein, 41 aa, Plasmodium falciparum
PLNIPKEILNITALLSSPILTTYNIKPICQVKFNYGYNNTK

SEQ ID NO: 3391717 - protein, 18 aa, Plasmodium falciparum
PLRIAFSLIDLTHKLFAQ

SEQ ID NO: 3391718 - protein, 26 aa, Plasmodium falciparum
PLRKETMYLLIPHFKYQRKYSDLPGF

SEQ ID NO: 3391719 - protein, 18 aa, Plasmodium falciparum
PLSDVPKMIGEDNSYVIY

SEQ ID NO: 3391720 - protein, 32 aa, Plasmodium falciparum
PLSSIHRVKLRLKFTLPYDLFCNIDKVHLIKC

SEQ ID NO: 3391721 - protein, 25 aa, Plasmodium falciparum
PLTNKTFLQFFFEQIIFLQEYCSLY

SEQ ID NO: 3391722 - protein, 20 aa, Plasmodium falciparum
PLVNGISTLSYKPYSTYNCI

SEQ ID NO: 3391723 - protein, 25 aa, Plasmodium falciparum
PLWEEHAFIPNIKIYEKDKLVCILK

SEQ ID NO: 3391724 - protein, 19 aa, Plasmodium falciparum
PLYEDLFAISFKNNDFKIN

SEQ ID NO: 3391725 - protein, 30 aa, Plasmodium falciparum
PLYTNLNTIINPPFNNQLANAVINLPLDQQ

SEQ ID NO: 3391726 - protein, 25 aa, Plasmodium falciparum
PMDKYRAFLCLYLAKKKNINIQTID

SEQ ID NO: 3391727 - protein, 19 aa, Plasmodium falciparum
PMHINKFHILNTLSTLKYN

SEQ ID NO: 3391728 - protein, 21 aa, Plasmodium falciparum
PMLKTYQAEGVWWMYTRENPP

SEQ ID NO: 3391729 - protein, 25 aa, Plasmodium falciparum
PMNPEVVPPILQLPASTNLIKNVHL

SEQ ID NO: 3391730 - protein, 24 aa, Plasmodium falciparum
PMPPNMKCFWSGKPAKRWCLFGRS

SEQ ID NO: 3391731 - protein, 18 aa, Plasmodium falciparum
PMTKNNLLNIFDSSINNL

SEQ ID NO: 3391732 - protein, 26 aa, Plasmodium falciparum
PMYVELFDRYSMILYILKSRAKNNLS

SEQ ID NO: 3391733 - protein, 17 aa, Plasmodium falciparum
PNDINMDYWLNFAKKHY

SEQ ID NO: 3391734 - protein, 18 aa, Plasmodium falciparum
PNEDILWNNNKTISSEKL

SEQ ID NO: 3391735 - protein, 24 aa, Plasmodium falciparum
PNEKHIKIMKYKKSYYKVIEQLNK

SEQ ID NO: 3391736 - protein, 25 aa, Plasmodium falciparum
PNEKYLTMYYFSFSLCGIIVDMFKK

SEQ ID NO: 3391737 - protein, 22 aa, Plasmodium falciparum
PNEMDIWLDTQLHMARLNSGHS

SEQ ID NO: 3391738 - protein, 24 aa, Plasmodium falciparum
PNEWQQTDLIQAFSPFGELLSARI

SEQ ID NO: 3391739 - protein, 21 aa, Plasmodium falciparum
PNEYYYLTLGFDKQNLHYGDK

SEQ ID NO: 3391740 - protein, 29 aa, Plasmodium falciparum
PNFSEVAKIIPQWKYSFEALNTRAHEDTR

SEQ ID NO: 3391741 - protein, 24 aa, Plasmodium falciparum
PNHGCTIISLIIFRNKMFVANLGD

SEQ ID NO: 3391742 - protein, 18 aa, Plasmodium falciparum
PNHTFLNNILILQYYRNR

SEQ ID NO: 3391743 - protein, 18 aa, Plasmodium falciparum
PNIDLKMLDEFLSSSNNN

SEQ ID NO: 3391744 - protein, 25 aa, Plasmodium falciparum
PNIFGKDIEFFTNKNVSYTQNNVED

SEQ ID NO: 3391745 - protein, 20 aa, Plasmodium falciparum
PNIFIKYFKCNKCLTYLSIE

SEQ ID NO: 3391746 - protein, 22 aa, Plasmodium falciparum
PNIHIPYRDSKLTRLLKNSLNG

SEQ ID NO: 3391747 - protein, 27 aa, Plasmodium falciparum
PNIKNSPDYPILRSPTRKLNKEEENDW

SEQ ID NO: 3391748 - protein, 19 aa, Plasmodium falciparum
PNILKSRKFLLKKLNKEKQ

SEQ ID NO: 3391749 - protein, 21 aa, Plasmodium falciparum
PNINDKFLYFFSKNNRNDKVE

SEQ ID NO: 3391750 - protein, 31 aa, Plasmodium falciparum
PNKNVLLDKIQILNLFKIFDNLPFEPKSDNE

SEQ ID NO: 3391751 - protein, 51 aa, Plasmodium falciparum
PNKYNYDMINQGNLNYMYNPLNYYNMNKYYDMPFIDNIANNLNPMYFDNDM

SEQ ID NO: 3391752 - protein, 27 aa, Plasmodium falciparum
PNKYYELRETDIIRFGSSNREFVLLHD

SEQ ID NO: 3391753 - protein, 23 aa, Plasmodium falciparum
PNLNQPHPVLKPDGLLVGPNNKF

SEQ ID NO: 3391754 - protein, 17 aa, Plasmodium falciparum
PNMLLVNNLVQATNPYL

SEQ ID NO: 3391755 - protein, 18 aa, Plasmodium falciparum
PNMNFKYSRINRIGGNYI

SEQ ID NO: 3391756 - protein, 17 aa, Plasmodium falciparum
PNNDNILASKEVKPFLG

SEQ ID NO: 3391757 - protein, 31 aa, Plasmodium falciparum
PNNEINIMSYYYNHILYRLRMKNKYEDIIHD

SEQ ID NO: 3391758 - protein, 29 aa, Plasmodium falciparum
PNNGILTPLLAVIPLQMLAYYTSVNKGIN

SEQ ID NO: 3391759 - protein, 44 aa, Plasmodium falciparum
PNNKEKPILYFIPYSYIVPPFSFFKYELVHLYSLKNYSVILFHT

SEQ ID NO: 3391760 - protein, 25 aa, Plasmodium falciparum
PNNRLRQIFYRKLYVYPGALHPHWG

SEQ ID NO: 3391761 - protein, 20 aa, Plasmodium falciparum
PNPAIHHCILLNDPSYFDKY

SEQ ID NO: 3391762 - protein, 38 aa, Plasmodium falciparum
PNPSLYEGNLYKYALTVIVNVPYWLKPSISKQEFIHEN

SEQ ID NO: 3391763 - protein, 21 aa, Plasmodium falciparum
PNRGYLWNKITKRVENWRLKY

SEQ ID NO: 3391764 - protein, 29 aa, Plasmodium falciparum
PNSLKETNFIYSYELYSGPKYVIDSTASE

SEQ ID NO: 3391765 - protein, 23 aa, Plasmodium falciparum
PNSLWSNIGPLLYHYAEMPNEMS

SEQ ID NO: 3391766 - protein, 17 aa, Plasmodium falciparum
PNSQESLKWLNGEINLI

SEQ ID NO: 3391767 - protein, 34 aa, Plasmodium falciparum
PNSSLFCPVCNIPFTYKIRINPCYHIICKTCYKL

SEQ ID NO: 3391768 - protein, 27 aa, Plasmodium falciparum
PNTKCRLKLLKLERIKDYLLLEEEYIT

SEQ ID NO: 3391769 - protein, 18 aa, Plasmodium falciparum
PNVCEHFSYFLNNKNEQE

SEQ ID NO: 3391770 - protein, 19 aa, Plasmodium falciparum
PNVHLHKWWQRHVRVNFSK

SEQ ID NO: 3391771 - protein, 21 aa, Plasmodium falciparum
PNVLVIILDININSLFSCFVK

SEQ ID NO: 3391772 - protein, 23 aa, Plasmodium falciparum
PNVSENYLSKMFDYLTNFKDEEI

SEQ ID NO: 3391773 - protein, 17 aa, Plasmodium falciparum
PNVSLIFDWKIADCADL

SEQ ID NO: 3391774 - protein, 20 aa, Plasmodium falciparum
PNVVFLGCDKLYDWDVFECE

SEQ ID NO: 3391775 - protein, 21 aa, Plasmodium falciparum
PPATPLFLQVAIRTNLDIFYF

SEQ ID NO: 3391776 - protein, 18 aa, Plasmodium falciparum
PPCIPIDMIYGKDGKYPV

SEQ ID NO: 3391777 - protein, 18 aa, Plasmodium falciparum
PPELMLSSSEKRKLLKNN

SEQ ID NO: 3391778 - protein, 24 aa, Plasmodium falciparum
PPGANVFVFHLPSHWTDMELYQHF

SEQ ID NO: 3391779 - protein, 18 aa, Plasmodium falciparum
PPGREAYPGDIFYIHSKL

SEQ ID NO: 3391780 - protein, 20 aa, Plasmodium falciparum
PPIITIPHKLHKITIYYPRR

SEQ ID NO: 3391781 - protein, 18 aa, Plasmodium falciparum
PPISDVWNDKIDIDNFEL

SEQ ID NO: 3391782 - protein, 33 aa, Plasmodium falciparum
PPKDIHVNIPLPYDIPQFYYTPDNRYSHILPCD

SEQ ID NO: 3391783 - protein, 26 aa, Plasmodium falciparum
PPKILKYSLRAISRYSMYINKFIMDD

SEQ ID NO: 3391784 - protein, 25 aa, Plasmodium falciparum
PPMYNQYYMYNGNNMYLPNGGPNNN

SEQ ID NO: 3391785 - protein, 38 aa, Plasmodium falciparum
PPQHVNTWYYWLENVRDWCISRQLWWGHRIPAYKIVFK

SEQ ID NO: 3391786 - protein, 17 aa, Plasmodium falciparum
PPQLYTTQDITQPIYTH

SEQ ID NO: 3391787 - protein, 34 aa, Plasmodium falciparum
PPSMQKQVLGENLFPLVANYHPTLAGKITGMMLE

SEQ ID NO: 3391788 - protein, 21 aa, Plasmodium falciparum
PPSSYLIFCNYERENAKNTLL

SEQ ID NO: 3391789 - protein, 34 aa, Plasmodium falciparum
PPSTDNRFFNISRKSLLLIPNDKQMKISNMSNTT

SEQ ID NO: 3391790 - protein, 23 aa, Plasmodium falciparum
PPTSQAFPNPWASKNTKNKNSIN

SEQ ID NO: 3391791 - protein, 21 aa, Plasmodium falciparum
PPYEKNILYYINNKNLGRYKN

SEQ ID NO: 3391792 - protein, 40 aa, Plasmodium falciparum
PQATIPAIDNYYLSQGLIGLRSFIIFCKNEEKMKNDGLPV

SEQ ID NO: 3391793 - protein, 26 aa, Plasmodium falciparum
PQFASFFKIELFLFIKGYSKEEKVVI

SEQ ID NO: 3391794 - protein, 27 aa, Plasmodium falciparum
PQGLDKDLFLAYNENKFALYRKEERLT

SEQ ID NO: 3391795 - protein, 33 aa, Plasmodium falciparum
PQGLIAPIQRIKYTGPTILDKINRESRPTWDDL

SEQ ID NO: 3391796 - protein, 26 aa, Plasmodium falciparum
PQIEELKHFLIKDYNFNELRVTNYIN

SEQ ID NO: 3391797 - protein, 35 aa, Plasmodium falciparum
PQKFIKYNLLYIIKNQRKIFFPLHVYVINTKQNEN

SEQ ID NO: 3391798 - protein, 26 aa, Plasmodium falciparum
PQKFMQRIRYLRRYGKIGQFVSIYDN

SEQ ID NO: 3391799 - protein, 21 aa, Plasmodium falciparum
PQLNIMGIMKDINNNNITVSN

SEQ ID NO: 3391800 - protein, 24 aa, Plasmodium falciparum
PQLYGIHPHGSSCLLPFTALGSGS

SEQ ID NO: 3391801 - protein, 19 aa, Plasmodium falciparum
PQMYLINYVIYVCKKRLLY

SEQ ID NO: 3391802 - protein, 29 aa, Plasmodium falciparum
PQNQKVIIPYKFQLICSLTKWNVQRTSEQ

SEQ ID NO: 3391803 - protein, 22 aa, Plasmodium falciparum
PQNTATLTNLTPDQISALNAHL

SEQ ID NO: 3391804 - protein, 23 aa, Plasmodium falciparum
PQPNFNYWYCPLCKRRGVTVDAS

SEQ ID NO: 3391805 - protein, 21 aa, Plasmodium falciparum
PQRMGWVGQAYKKCKRIERIF

SEQ ID NO: 3391806 - protein, 22 aa, Plasmodium falciparum
PQSLAVEYFKKKKLRNPVVVSI

SEQ ID NO: 3391807 - protein, 17 aa, Plasmodium falciparum
PQSLLQHLNLEDVKNFL

SEQ ID NO: 3391808 - protein, 21 aa, Plasmodium falciparum
PQTLFHLLKNLNSIKYRDSLI

SEQ ID NO: 3391809 - protein, 38 aa, Plasmodium falciparum
PRGVGKWNAYFQIANNKRLFTSFSVSKYGYNEARKLSI

SEQ ID NO: 3391810 - protein, 22 aa, Plasmodium falciparum
PRHGSLGFLPRKRCKRLRGKIR

SEQ ID NO: 3391811 - protein, 22 aa, Plasmodium falciparum
PRILIFTCIVLAIKIEGYGRLY

SEQ ID NO: 3391812 - protein, 26 aa, Plasmodium falciparum
PRPVQYFYQCGLPSKILQILEKKNFK

SEQ ID NO: 3391813 - protein, 19 aa, Plasmodium falciparum
PRRQKLCVDFLKQLKDQTD

SEQ ID NO: 3391814 - protein, 35 aa, Plasmodium falciparum
PRRVNYFLKNFLHKILPYFFKELQFIESYISLITL

SEQ ID NO: 3391815 - protein, 24 aa, Plasmodium falciparum
PRYIRIQRKKKILLQRLKVPPSIN

SEQ ID NO: 3391816 - protein, 27 aa, Plasmodium falciparum
PSALQCLGYQIIKNVSVPILSKKEHGT

SEQ ID NO: 3391817 - protein, 26 aa, Plasmodium falciparum
PSAYTMLQHPWLNMVSLEEGDDMYIN

SEQ ID NO: 3391818 - protein, 26 aa, Plasmodium falciparum
PSEIIADCYCNLGLLYRLTGNVVESL

SEQ ID NO: 3391819 - protein, 17 aa, Plasmodium falciparum
PSFIFYEKTYEGDDTCF

SEQ ID NO: 3391820 - protein, 23 aa, Plasmodium falciparum
PSFLNGLQVWYKMVRDDGWVGFD

SEQ ID NO: 3391821 - protein, 69 aa, Plasmodium falciparum
PSGNVQGPFSSELMFYWWCLNYFPYDLPIRFNESMPWVRFNDMFPFGSFPFVLPLTSMKKNLKNVEPED

SEQ ID NO: 3391822 - protein, 18 aa, Plasmodium falciparum
PSGRIYHKIFNPPKVPFR

SEQ ID NO: 3391823 - protein, 17 aa, Plasmodium falciparum
PSHKQIYLELEKIKTYA

SEQ ID NO: 3391824 - protein, 21 aa, Plasmodium falciparum
PSHNMLLYYTDIMKNGIKLID

SEQ ID NO: 3391825 - protein, 20 aa, Plasmodium falciparum
PSIITYEYLLHNIHAHVKQH

SEQ ID NO: 3391826 - protein, 18 aa, Plasmodium falciparum
PSIKYNYSSLFLAKLYNS

SEQ ID NO: 3391827 - protein, 27 aa, Plasmodium falciparum
PSIMFVKISFKLLILVLKENYEIKAKI

SEQ ID NO: 3391828 - protein, 33 aa, Plasmodium falciparum
PSINKILCLSKYKILLIGFQFINYINIVKEKRR

SEQ ID NO: 3391829 - protein, 27 aa, Plasmodium falciparum
PSISLVINFDLPYIYQGRIGDTLNNTS

SEQ ID NO: 3391830 - protein, 27 aa, Plasmodium falciparum
PSKQEYYKDVLFLKWTKEEHKKNNDME

SEQ ID NO: 3391831 - protein, 22 aa, Plasmodium falciparum
PSLDYITTKIPRWDLNKFEFAS

SEQ ID NO: 3391832 - protein, 26 aa, Plasmodium falciparum
PSLEHTYIYPYNYYKGFEELKPLRKK

SEQ ID NO: 3391833 - protein, 17 aa, Plasmodium falciparum
PSLLYTNINNFFIEPNN

SEQ ID NO: 3391834 - protein, 36 aa, Plasmodium falciparum
PSLNKYIYNNFFRLYNYKFNWLNICRKHFLKNYRFN

SEQ ID NO: 3391835 - protein, 17 aa, Plasmodium falciparum
PSLRNICKYGKITCKNN

SEQ ID NO: 3391836 - protein, 17 aa, Plasmodium falciparum
PSNFFLIEFPNNFTYNT

SEQ ID NO: 3391837 - protein, 17 aa, Plasmodium falciparum
PSNKLVNYKNGLGGKNN

SEQ ID NO: 3391838 - protein, 23 aa, Plasmodium falciparum
PSNMCPDIFFQDIQNFINFAKRK

SEQ ID NO: 3391839 - protein, 17 aa, Plasmodium falciparum
PSNRLIIQLLNELTSMY

SEQ ID NO: 3391840 - protein, 24 aa, Plasmodium falciparum
PSNTIPPCVIYYNKKKFKDNISEK

SEQ ID NO: 3391841 - protein, 26 aa, Plasmodium falciparum
PSRYGLSCMQGWRKNMEDAHICYNNL

SEQ ID NO: 3391842 - protein, 21 aa, Plasmodium falciparum
PSSPKMLELLVSWTVLHKDMN

SEQ ID NO: 3391843 - protein, 24 aa, Plasmodium falciparum
PSYIYYNNSCLLLNDDGPLVVLEY

SEQ ID NO: 3391844 - protein, 25 aa, Plasmodium falciparum
PSYLIELLHRLLKIFKDFCGQITEE

SEQ ID NO: 3391845 - protein, 17 aa, Plasmodium falciparum
PTDINFLNLASSYIYFL

SEQ ID NO: 3391846 - protein, 34 aa, Plasmodium falciparum
PTFLSKFCMLKRKFVYNFFLVKKEIVKKRLWTYI

SEQ ID NO: 3391847 - protein, 23 aa, Plasmodium falciparum
PTGDLYKTAPCTKFLRGKCNAEE

SEQ ID NO: 3391848 - protein, 19 aa, Plasmodium falciparum
PTIVNRLKLIFKFSKYYKH

SEQ ID NO: 3391849 - protein, 25 aa, Plasmodium falciparum
PTIYTENICFLYGVLRTDVAILLNL

SEQ ID NO: 3391850 - protein, 42 aa, Plasmodium falciparum
PTKYECPGWLTKRRIKKYFDFCVIKLCKPTLIKGIDIDTNNF

SEQ ID NO: 3391851 - protein, 24 aa, Plasmodium falciparum
PTLKDLQEMFLRIQFRSSTKHHMN

SEQ ID NO: 3391852 - protein, 20 aa, Plasmodium falciparum
PTMQIILMLNEEKNFLIEKI

SEQ ID NO: 3391853 - protein, 17 aa, Plasmodium falciparum
PTNIINHRNAFLSILKL

SEQ ID NO: 3391854 - protein, 23 aa, Plasmodium falciparum
PTNILYEPIYVLSGGQKSKLALA

SEQ ID NO: 3391855 - protein, 17 aa, Plasmodium falciparum
PTNPLLLNYYMKRNEEE

SEQ ID NO: 3391856 - protein, 18 aa, Plasmodium falciparum
PTRFCSLTLWVSNPQETK

SEQ ID NO: 3391857 - protein, 20 aa, Plasmodium falciparum
PTSVKLWLEAYKKEKNVDDK

SEQ ID NO: 3391858 - protein, 26 aa, Plasmodium falciparum
PTSYLDFCEAWSKFKFRNLASHANDQ

SEQ ID NO: 3391859 - protein, 31 aa, Plasmodium falciparum
PTVAHLGEENKFYFNKELNRWVIKGEEDKIE

SEQ ID NO: 3391860 - protein, 23 aa, Plasmodium falciparum
PTVCTIYYRPLEVLLSKFELSNK

SEQ ID NO: 3391861 - protein, 20 aa, Plasmodium falciparum
PTYSPILDDGIEFSGGLYFN

SEQ ID NO: 3391862 - protein, 17 aa, Plasmodium falciparum
PVFSFHKNLSLNSRIQN

SEQ ID NO: 3391863 - protein, 17 aa, Plasmodium falciparum
PVGLKNYAAAYATGLLC

SEQ ID NO: 3391864 - protein, 22 aa, Plasmodium falciparum
PVKLIIIPLDAFLLDTKTGYPY

SEQ ID NO: 3391865 - protein, 28 aa, Plasmodium falciparum
PVKNSYGFMTFLVLDCHTNNFFIDTGIK

SEQ ID NO: 3391866 - protein, 25 aa, Plasmodium falciparum
PVKSEWLNPVYVRSSYFYSKKYSSS

SEQ ID NO: 3391867 - protein, 21 aa, Plasmodium falciparum
PVLISIDLAFKVLTYLCAHFY

SEQ ID NO: 3391868 - protein, 35 aa, Plasmodium falciparum
PVLKFRDTFVPVPVRRKIIPKIKWISDVYQVDCIK

SEQ ID NO: 3391869 - protein, 25 aa, Plasmodium falciparum
PVMNQINLFHKWLDRHRDMCEKWNK

SEQ ID NO: 3391870 - protein, 26 aa, Plasmodium falciparum
PVNISYQICLIYAATKDYLLNLPIEK

SEQ ID NO: 3391871 - protein, 24 aa, Plasmodium falciparum
PVQEKEKCFFILQKRFKESTTDFD

SEQ ID NO: 3391872 - protein, 18 aa, Plasmodium falciparum
PVSDFHKVNLRPITGFIQ

SEQ ID NO: 3391873 - protein, 24 aa, Plasmodium falciparum
PVSKKIIPKITWTDKIYQVDCLIE

SEQ ID NO: 3391874 - protein, 18 aa, Plasmodium falciparum
PVVPQYDKICRHIFVENP

SEQ ID NO: 3391875 - protein, 18 aa, Plasmodium falciparum
PVVVFPTGFYNNEIKIVE

SEQ ID NO: 3391876 - protein, 23 aa, Plasmodium falciparum
PYDEAFSFLCGYIGKNINEYKKD

SEQ ID NO: 3391877 - protein, 17 aa, Plasmodium falciparum
PYDKKKYIFCNKNRLIS

SEQ ID NO: 3391878 - protein, 18 aa, Plasmodium falciparum
PYDYIYPEQYAYMKYLKK

SEQ ID NO: 3391879 - protein, 18 aa, Plasmodium falciparum
PYEKALSSTISQINKNRD

SEQ ID NO: 3391880 - protein, 20 aa, Plasmodium falciparum
PYERHLIDLISYEDVLYPSN

SEQ ID NO: 3391881 - protein, 18 aa, Plasmodium falciparum
PYFMVAFENNITIYNLKA

SEQ ID NO: 3391882 - protein, 18 aa, Plasmodium falciparum
PYFSVFLTKKKYSRRLKK

SEQ ID NO: 3391883 - protein, 27 aa, Plasmodium falciparum
PYHLPNFMNLFTWSLPFVSEKVTEMLY

SEQ ID NO: 3391884 - protein, 17 aa, Plasmodium falciparum
PYILHICDPFYKIFLQF

SEQ ID NO: 3391885 - protein, 21 aa, Plasmodium falciparum
PYISMYVHPCGDFLYASNRNE

SEQ ID NO: 3391886 - protein, 25 aa, Plasmodium falciparum
PYKNSYNIKLYTKLGISVTYTLIGG

SEQ ID NO: 3391887 - protein, 18 aa, Plasmodium falciparum
PYKYYENKRKRDFLFFIN

SEQ ID NO: 3391888 - protein, 17 aa, Plasmodium falciparum
PYLSYDEKYNDMMIMLM

SEQ ID NO: 3391889 - protein, 36 aa, Plasmodium falciparum
PYMKKNNYEFDQRNLYFFISNFNLMDKIFSDSHGFD

SEQ ID NO: 3391890 - protein, 19 aa, Plasmodium falciparum
PYMLLKNAMFNFILHQYVK

SEQ ID NO: 3391891 - protein, 22 aa, Plasmodium falciparum
PYNFCFHDFFIFLQNNLDEARA

SEQ ID NO: 3391892 - protein, 31 aa, Plasmodium falciparum
PYNNMPYNGYTTQALVPQYGLMNNHYNKSSS

SEQ ID NO: 3391893 - protein, 24 aa, Plasmodium falciparum
PYNSIKLKDLLYLLPDDGNVIFSE

SEQ ID NO: 3391894 - protein, 17 aa, Plasmodium falciparum
PYRDSKLTRVLSDSLGN

SEQ ID NO: 3391895 - protein, 22 aa, Plasmodium falciparum
PYSITLIRLLRDFFNVVFKIEK

SEQ ID NO: 3391896 - protein, 24 aa, Plasmodium falciparum
PYSYIYVQNKLFYISPSSINILYA

SEQ ID NO: 3391897 - protein, 29 aa, Plasmodium falciparum
PYTKSKSKFHMFFYKNKYSSSKYNNNNVN

SEQ ID NO: 3391898 - protein, 28 aa, Plasmodium falciparum
PYTNNPYYLIDFFNISFYKSPNLYISLA

SEQ ID NO: 3391899 - protein, 17 aa, Plasmodium falciparum
PYVINDYKKKMYQHKHM

SEQ ID NO: 3391900 - protein, 45 aa, Plasmodium falciparum
PYVTQLSVEFFFLPSIFWKFSSNPIFLSWPPFPSFSPFKSQYAHL

SEQ ID NO: 3391901 - protein, 17 aa, Plasmodium falciparum
PYYECYIEFMKMKKTYN

SEQ ID NO: 3391902 - protein, 26 aa, Plasmodium falciparum
QADEGHLIYHYIPSIHKVNTHNINHY

SEQ ID NO: 3391903 - protein, 18 aa, Plasmodium falciparum
QADHFFSHKQYYAALNMY

SEQ ID NO: 3391904 - protein, 20 aa, Plasmodium falciparum
QAEFLLREKEDYLFNEIMGL

SEQ ID NO: 3391905 - protein, 18 aa, Plasmodium falciparum
QAESLRYKLLKGLAVRRA

SEQ ID NO: 3391906 - protein, 30 aa, Plasmodium falciparum
QAFINHNYHYLNDKYFSVLIVPLCKDEQLL

SEQ ID NO: 3391907 - protein, 18 aa, Plasmodium falciparum
QAFYRPQEDYAFANNIRA

SEQ ID NO: 3391908 - protein, 30 aa, Plasmodium falciparum
QAGELMIKTFPQRIKAVFLHHVKGKDDNTL

SEQ ID NO: 3391909 - protein, 33 aa, Plasmodium falciparum
QAHSLLSNELSKFLPINFILKMPSTNNEHKKAL

SEQ ID NO: 3391910 - protein, 26 aa, Plasmodium falciparum
QAIHSYMIAKKYYSKYFGYYLTGDMS

SEQ ID NO: 3391911 - protein, 20 aa, Plasmodium falciparum
QAIIFVELRHSINNVFNFLK

SEQ ID NO: 3391912 - protein, 33 aa, Plasmodium falciparum
QAKCFRTQLPRNNPFYNYYLQDSNYVDDPTNEN

SEQ ID NO: 3391913 - protein, 20 aa, Plasmodium falciparum
QAKKYYPNIDLKMLDEFLSS

SEQ ID NO: 3391914 - protein, 34 aa, Plasmodium falciparum
QALIHLQFNSDLWFSYFQYLLLNKKFVYAIRIMR

SEQ ID NO: 3391915 - protein, 20 aa, Plasmodium falciparum
QALRWLSHLIREEHICVVKN

SEQ ID NO: 3391916 - protein, 23 aa, Plasmodium falciparum
QAQFYLGSIILAIEYLHERNIVY

SEQ ID NO: 3391917 - protein, 22 aa, Plasmodium falciparum
QASWEYVSKFVIIIMDGTNNKS

SEQ ID NO: 3391918 - protein, 40 aa, Plasmodium falciparum
QATDLKQLTALCKLPLDDSLLNFLKNFKKADEIYTFLQHS

SEQ ID NO: 3391919 - protein, 17 aa, Plasmodium falciparum
QATPLFYVTARKSDEES

SEQ ID NO: 3391920 - protein, 24 aa, Plasmodium falciparum
QAVPQIEKLLPLVKLNMGFVFCKD

SEQ ID NO: 3391921 - protein, 17 aa, Plasmodium falciparum
QAYINIIIFCKNKNRDE

SEQ ID NO: 3391922 - protein, 40 aa, Plasmodium falciparum
QCDLCEKWRRLPQNINMENLPKVWYCKLNNDVRYNSCDIQ

SEQ ID NO: 3391923 - protein, 26 aa, Plasmodium falciparum
QCEYFKKWDIKIIFIFDGITPKGHKL

SEQ ID NO: 3391924 - protein, 17 aa, Plasmodium falciparum
QCGNLLIHCATCPTSFC

SEQ ID NO: 3391925 - protein, 21 aa, Plasmodium falciparum
QCKSCFIYIIKNYYPFIKKAM

SEQ ID NO: 3391926 - protein, 23 aa, Plasmodium falciparum
QCLKFYMYSQLYTKHYIFIELIF

SEQ ID NO: 3391927 - protein, 23 aa, Plasmodium falciparum
QCNSRLRIIKDNETDKVWLELSG

SEQ ID NO: 3391928 - protein, 18 aa, Plasmodium falciparum
QCPICKTSCKSSRELIIC

SEQ ID NO: 3391929 - protein, 24 aa, Plasmodium falciparum
QCPINKYCMIYLKSNKKKQHNLFN

SEQ ID NO: 3391930 - protein, 22 aa, Plasmodium falciparum
QCSDLIVLVISLDDGIMSETIE

SEQ ID NO: 3391931 - protein, 18 aa, Plasmodium falciparum
QCTIYLRRRPKNLTLSSP

SEQ ID NO: 3391932 - protein, 24 aa, Plasmodium falciparum
QCTKEILIIVSMLSSPSIFLESKE

SEQ ID NO: 3391933 - protein, 25 aa, Plasmodium falciparum
QCVDISKYYQILINSLNDEIKNLKH

SEQ ID NO: 3391934 - protein, 35 aa, Plasmodium falciparum
QDAALFMNTYKVHKLPYLCVLCKRTGRQLKVWNIR

SEQ ID NO: 3391935 - protein, 25 aa, Plasmodium falciparum
QDCDKLLFLWLHECERVYSDKLNKK

SEQ ID NO: 3391936 - protein, 28 aa, Plasmodium falciparum
QDEETYLNFSYMKNIEKFKELLINATRD

SEQ ID NO: 3391937 - protein, 18 aa, Plasmodium falciparum
QDEKLLSDQLHLDSLYKT

SEQ ID NO: 3391938 - protein, 19 aa, Plasmodium falciparum
QDEYNYQSCYPLSYLNVYN

SEQ ID NO: 3391939 - protein, 23 aa, Plasmodium falciparum
QDFRRLDRILRKIKQRDEKKLLL

SEQ ID NO: 3391940 - protein, 26 aa, Plasmodium falciparum
QDILFSFAIIMHQLNNFKMALQLYKE

SEQ ID NO: 3391941 - protein, 17 aa, Plasmodium falciparum
QDILLNSLHFFFQNNIT

SEQ ID NO: 3391942 - protein, 29 aa, Plasmodium falciparum
QDILQHNFDNFLLLYKNKKKKKKEMINLY

SEQ ID NO: 3391943 - protein, 22 aa, Plasmodium falciparum
QDILWSKKWRNLIQQKAIKEEM

SEQ ID NO: 3391944 - protein, 20 aa, Plasmodium falciparum
QDKMIRLWDLNNGKCRISLT

SEQ ID NO: 3391945 - protein, 24 aa, Plasmodium falciparum
QDKTYVCPMWNYFKDYKIEKIYKK

SEQ ID NO: 3391946 - protein, 17 aa, Plasmodium falciparum
QDLFDMEILIENLKLFV

SEQ ID NO: 3391947 - protein, 33 aa, Plasmodium falciparum
QDLTYPLMELIDTSFKFCYFFQCLVENELFTDI

SEQ ID NO: 3391948 - protein, 19 aa, Plasmodium falciparum
QDMDICSDWLKFNDYDKKV

SEQ ID NO: 3391949 - protein, 24 aa, Plasmodium falciparum
QDNRGYVLDTLKDKTFKIILNKNE

SEQ ID NO: 3391950 - protein, 19 aa, Plasmodium falciparum
QDPICAQSQLYEFIEMMEI

SEQ ID NO: 3391951 - protein, 29 aa, Plasmodium falciparum
QDSFEKNVLYLQNILRGKAIKILMNDGKN

SEQ ID NO: 3391952 - protein, 25 aa, Plasmodium falciparum
QDTFRNILFIQPFEKKQIAFDKFEN

SEQ ID NO: 3391953 - protein, 27 aa, Plasmodium falciparum
QDVIRRVLNIFLILNYSHASVIYSIRN

SEQ ID NO: 3391954 - protein, 18 aa, Plasmodium falciparum
QDVKLQKLLLKYYKNYIN

SEQ ID NO: 3391955 - protein, 25 aa, Plasmodium falciparum
QDVKSLIRLYGILQFVHVYKLNKDR

SEQ ID NO: 3391956 - protein, 17 aa, Plasmodium falciparum
QEDLLEYISSSLELENE

SEQ ID NO: 3391957 - protein, 29 aa, Plasmodium falciparum
QEDLNNLFSHLFLIENWSSQIKMNDKNEE

SEQ ID NO: 3391958 - protein, 34 aa, Plasmodium falciparum
QEDLYVDEIGRLLLLSFDNLCTLLVDQIKDVKLG

SEQ ID NO: 3391959 - protein, 18 aa, Plasmodium falciparum
QEEKNLLQLIDSYKKEKE

SEQ ID NO: 3391960 - protein, 25 aa, Plasmodium falciparum
QEELINISLLCGCDYTIGVHGIGIV

SEQ ID NO: 3391961 - protein, 27 aa, Plasmodium falciparum
QEELKNKKPFIMKKYKNVTSKVAKNLL

SEQ ID NO: 3391962 - protein, 30 aa, Plasmodium falciparum
QEGVADIYLDLHKKIFSYRKYQEYLTHWNS

SEQ ID NO: 3391963 - protein, 26 aa, Plasmodium falciparum
QEGVHPISRIFLYLKNKNLYSEKEDQ

SEQ ID NO: 3391964 - protein, 27 aa, Plasmodium falciparum
QEIQNEHFLDFFKPSLGEFGYEGVYKQ

SEQ ID NO: 3391965 - protein, 50 aa, Plasmodium falciparum
QEIVNILKKAFEKRLYLMWPLIEFSNKYRLDQYFHLLGKNKNHINSSFKD

SEQ ID NO: 3391966 - protein, 22 aa, Plasmodium falciparum
QEKEYWYNLSNLTPDHMITLWK

SEQ ID NO: 3391967 - protein, 31 aa, Plasmodium falciparum
QEKKDAIYPFFQKLFHLFYAHYEKYVSACRL

SEQ ID NO: 3391968 - protein, 18 aa, Plasmodium falciparum
QEKLQEEKMMQSLGLPLG

SEQ ID NO: 3391969 - protein, 17 aa, Plasmodium falciparum
QEKNMYFDLNDNAYINV

SEQ ID NO: 3391970 - protein, 24 aa, Plasmodium falciparum
QEKNVFFYGFMFTKYYNKYKRENG

SEQ ID NO: 3391971 - protein, 17 aa, Plasmodium falciparum
QEKRNLYLLLNHDNIVK

SEQ ID NO: 3391972 - protein, 18 aa, Plasmodium falciparum
QEKRRIKNLIKLKRGENK

SEQ ID NO: 3391973 - protein, 24 aa, Plasmodium falciparum
QEKYRNVDLFFKNKYKTLISDIEK

SEQ ID NO: 3391974 - protein, 24 aa, Plasmodium falciparum
QELKSIIFTDVSFELSFNAKNVRG

SEQ ID NO: 3391975 - protein, 24 aa, Plasmodium falciparum
QELQPFLGSYYQDIFNYITSCRTL

SEQ ID NO: 3391976 - protein, 18 aa, Plasmodium falciparum
QENGLLRFQFTLKEYNMN

SEQ ID NO: 3391977 - protein, 23 aa, Plasmodium falciparum
QENKDIWTHFINQLNIKNKSYNH

SEQ ID NO: 3391978 - protein, 26 aa, Plasmodium falciparum
QENKLQYIKTLRSLTFNKFPIKNNLK

SEQ ID NO: 3391979 - protein, 26 aa, Plasmodium falciparum
QENLFNYYFYEFIKYTKISLSSKHHL

SEQ ID NO: 3391980 - protein, 30 aa, Plasmodium falciparum
QENQGLLDWFCIPLLQHSVFYDISFSKQKK

SEQ ID NO: 3391981 - protein, 33 aa, Plasmodium falciparum
QENTNDQMCLSCSGLPCHCKVGEATLVYSPIML

SEQ ID NO: 3391982 - protein, 27 aa, Plasmodium falciparum
QENYPHKLYTYKLDPNFVFLKPHNIDS

SEQ ID NO: 3391983 - protein, 18 aa, Plasmodium falciparum
QERCCAYNLLHESVLFTF

SEQ ID NO: 3391984 - protein, 20 aa, Plasmodium falciparum
QERFILIDTLKKKKLFKKSI

SEQ ID NO: 3391985 - protein, 24 aa, Plasmodium falciparum
QERFRSMAPLYYRDAYGAVVVYDS

SEQ ID NO: 3391986 - protein, 18 aa, Plasmodium falciparum
QERVDIVHYLKTLTYDDP

SEQ ID NO: 3391987 - protein, 20 aa, Plasmodium falciparum
QESHKFLKFIKIYTQIENIA

SEQ ID NO: 3391988 - protein, 33 aa, Plasmodium falciparum
QETDSFFQILLINKIFDEWLFNDIVQYLKCIKY

SEQ ID NO: 3391989 - protein, 23 aa, Plasmodium falciparum
QEVCKVQLSFYKTQKYACPSECM

SEQ ID NO: 3391990 - protein, 23 aa, Plasmodium falciparum
QEVKRNQFFISEKTKKGTSKDAQ

SEQ ID NO: 3391991 - protein, 19 aa, Plasmodium falciparum
QEYPKRSDLWFTYLDIHIN

SEQ ID NO: 3391992 - protein, 23 aa, Plasmodium falciparum
QEYYLKFIITINTFCSFLKILKP

SEQ ID NO: 3391993 - protein, 19 aa, Plasmodium falciparum
QFCLEHFINFFTYSITKYK

SEQ ID NO: 3391994 - protein, 23 aa, Plasmodium falciparum
QFDKGILFYLKNRSLIEIWDFKT

SEQ ID NO: 3391995 - protein, 20 aa, Plasmodium falciparum
QFDRLYKRRAFLENYKKESM

SEQ ID NO: 3391996 - protein, 17 aa, Plasmodium falciparum
QFDYILPRIAECFSYHN

SEQ ID NO: 3391997 - protein, 23 aa, Plasmodium falciparum
QFEKDLVAFLKKNGKSKLTELGK

SEQ ID NO: 3391998 - protein, 26 aa, Plasmodium falciparum
QFENKMNEYVIFLKKKDSEIYMLKEL

SEQ ID NO: 3391999 - protein, 19 aa, Plasmodium falciparum
QFFITTVPCPWLDFKHTVF

SEQ ID NO: 3392000 - protein, 26 aa, Plasmodium falciparum
QFHLGYNMILNLLRIEGITPEFMIER

SEQ ID NO: 3392001 - protein, 19 aa, Plasmodium falciparum
QFIFHQNLFCPKKIIYCTF

SEQ ID NO: 3392002 - protein, 20 aa, Plasmodium falciparum
QFIHLIIYDGFNKKIPYEIN

SEQ ID NO: 3392003 - protein, 24 aa, Plasmodium falciparum
QFINYDDVIFRKFKFHKNLFVNMD

SEQ ID NO: 3392004 - protein, 30 aa, Plasmodium falciparum
QFINYNDCIILIDILYHLTNFGKDNYIFLF

SEQ ID NO: 3392005 - protein, 18 aa, Plasmodium falciparum
QFIRFYCIMCNSERICII

SEQ ID NO: 3392006 - protein, 18 aa, Plasmodium falciparum
QFIYYPKVPLHQIQAFSR

SEQ ID NO: 3392007 - protein, 22 aa, Plasmodium falciparum
QFKELTHLSLVLKKGDNTNVIT

SEQ ID NO: 3392008 - protein, 17 aa, Plasmodium falciparum
QFLNTLYHIDVELSPVN

SEQ ID NO: 3392009 - protein, 17 aa, Plasmodium falciparum
QFLSLYNKPSSGTKVLY

SEQ ID NO: 3392010 - protein, 22 aa, Plasmodium falciparum
QFMNGYFVNNKYLKVQLKKGET

SEQ ID NO: 3392011 - protein, 22 aa, Plasmodium falciparum
QFNCMIYFQHRSTKLSILIYKS

SEQ ID NO: 3392012 - protein, 20 aa, Plasmodium falciparum
QFNDDLFCTCGYDNAFRLIN

SEQ ID NO: 3392013 - protein, 46 aa, Plasmodium falciparum
QFNDENYFYHFTQIISIEKTYFDLKTILFYTKKYDKIKKKIIKRIR

SEQ ID NO: 3392014 - protein, 28 aa, Plasmodium falciparum
QFNEPNSKYFIFLLSTRAGGIGINLTTA

SEQ ID NO: 3392015 - protein, 18 aa, Plasmodium falciparum
QFNILQFFVNHNVPSTLD

SEQ ID NO: 3392016 - protein, 25 aa, Plasmodium falciparum
QFNKSFFQQFIKEKYSKYLYTNTKE

SEQ ID NO: 3392017 - protein, 26 aa, Plasmodium falciparum
QFNLKNYPPFSFKVSLAGLKIPTENK

SEQ ID NO: 3392018 - protein, 28 aa, Plasmodium falciparum
QFNNGTIKLLLLNILCRIYQRNKIIEEN

SEQ ID NO: 3392019 - protein, 19 aa, Plasmodium falciparum
QFRVCWLDDNGVQRKNRCF

SEQ ID NO: 3392020 - protein, 23 aa, Plasmodium falciparum
QFSNFAFKLLGQSLEYLISKISS

SEQ ID NO: 3392021 - protein, 33 aa, Plasmodium falciparum
QFSSFVFQYYTIIIDLLILGLTRAYDIAGPYND

SEQ ID NO: 3392022 - protein, 31 aa, Plasmodium falciparum
QFVETNRLRALYIQLLHKQHNLFRDRNFYKC

SEQ ID NO: 3392023 - protein, 21 aa, Plasmodium falciparum
QFVLNSWICMSRILAFSDGHN

SEQ ID NO: 3392024 - protein, 18 aa, Plasmodium falciparum
QFVSTEMSLWWAGKEMNE

SEQ ID NO: 3392025 - protein, 18 aa, Plasmodium falciparum
QFYNARILEAIKMRWIKI

SEQ ID NO: 3392026 - protein, 25 aa, Plasmodium falciparum
QGEKNKFKNIHFKGNKRRIMNITNI

SEQ ID NO: 3392027 - protein, 21 aa, Plasmodium falciparum
QGFAYLKCNVPQKPNGKVNLK

SEQ ID NO: 3392028 - protein, 25 aa, Plasmodium falciparum
QGISNYVFKPYYYDTLPSASYDNRN

SEQ ID NO: 3392029 - protein, 21 aa, Plasmodium falciparum
QGIYYIIHRALERVKTIYCRI

SEQ ID NO: 3392030 - protein, 21 aa, Plasmodium falciparum
QGKIIIDLNLFNGNSVKTTNK

SEQ ID NO: 3392031 - protein, 24 aa, Plasmodium falciparum
QGLADTFMLLRYPYESDAAKELNK

SEQ ID NO: 3392032 - protein, 25 aa, Plasmodium falciparum
QGLCKIYLNWISELEKRIILYKEKN

SEQ ID NO: 3392033 - protein, 17 aa, Plasmodium falciparum
QGNCGLCWIFASKLHFE

SEQ ID NO: 3392034 - protein, 18 aa, Plasmodium falciparum
QGNRGFGFVSYDNKKSAI

SEQ ID NO: 3392035 - protein, 25 aa, Plasmodium falciparum
QGRHDSCILPRLPPIIEASSSMVIG

SEQ ID NO: 3392036 - protein, 26 aa, Plasmodium falciparum
QGVKNNYLFFLNLDKKDIIKYKYTDS

SEQ ID NO: 3392037 - protein, 29 aa, Plasmodium falciparum
QGVLTNNRVRLLFKKGMKCYRPRKKGERK

SEQ ID NO: 3392038 - protein, 22 aa, Plasmodium falciparum
QGYIDLKTKRKLIYDALDEINQ

SEQ ID NO: 3392039 - protein, 19 aa, Plasmodium falciparum
QHAIQFMNGYFVNNKYLKV

SEQ ID NO: 3392040 - protein, 22 aa, Plasmodium falciparum
QHDNYLNLNNEKIPLIITGGQN

SEQ ID NO: 3392041 - protein, 20 aa, Plasmodium falciparum
QHFDILPHTTIKCIIHPSVI

SEQ ID NO: 3392042 - protein, 24 aa, Plasmodium falciparum
QHFNYPYIYNAYLVPPIDVYQLDN

SEQ ID NO: 3392043 - protein, 18 aa, Plasmodium falciparum
QHFWKTKLCPLHMENRCN

SEQ ID NO: 3392044 - protein, 19 aa, Plasmodium falciparum
QHGYKIKDRILRAAKVGVV

SEQ ID NO: 3392045 - protein, 24 aa, Plasmodium falciparum
QHIKNYFSYSHFYVYYCTFCQTSS

SEQ ID NO: 3392046 - protein, 23 aa, Plasmodium falciparum
QHKQHTYMLNTNHVKYLPNISRD

SEQ ID NO: 3392047 - protein, 26 aa, Plasmodium falciparum
QHLKQLYLYINYISQMKKNLLCIWNG

SEQ ID NO: 3392048 - protein, 18 aa, Plasmodium falciparum
QHMIPYHISTFIISNLAH

SEQ ID NO: 3392049 - protein, 21 aa, Plasmodium falciparum
QHMMLSLKEFLAKICPKFPQF

SEQ ID NO: 3392050 - protein, 26 aa, Plasmodium falciparum
QHMNDLLNNITLWRKYQEDKEKESLS

SEQ ID NO: 3392051 - protein, 25 aa, Plasmodium falciparum
QHNNNLSHITVLEKKNKALNKQVKY

SEQ ID NO: 3392052 - protein, 28 aa, Plasmodium falciparum
QHRILYDLGWNIRRVVWIDWIQFGDDTH

SEQ ID NO: 3392053 - protein, 25 aa, Plasmodium falciparum
QHSKSKIILIGIANSLDLIKDYNHM

SEQ ID NO: 3392054 - protein, 17 aa, Plasmodium falciparum
QIAYMIKHDYEKLKKQY

SEQ ID NO: 3392055 - protein, 18 aa, Plasmodium falciparum
QICSPGVSSPFISAPKQA

SEQ ID NO: 3392056 - protein, 19 aa, Plasmodium falciparum
QIDAIKRSLLSPLSLIQGP

SEQ ID NO: 3392057 - protein, 17 aa, Plasmodium falciparum
QIDISYLCKMDCLVAKA

SEQ ID NO: 3392058 - protein, 63 aa, Plasmodium falciparum
QIDKNSNLWYHPSLVFRFDKKDPYYPSRVALPLLASWVVFNQPLSILAVEKLLNSSLTLSEVK

SEQ ID NO: 3392059 - protein, 21 aa, Plasmodium falciparum
QIDLILFPVNKNYYMNLFDGQ

SEQ ID NO: 3392060 - protein, 21 aa, Plasmodium falciparum
QIDNLLHKFITNNDAIHLENE

SEQ ID NO: 3392061 - protein, 20 aa, Plasmodium falciparum
QIDRKIYNFINYSMHHIING

SEQ ID NO: 3392062 - protein, 28 aa, Plasmodium falciparum
QIDYCLTLWGNFEPFLEDHLLDYKMFSA

SEQ ID NO: 3392063 - protein, 20 aa, Plasmodium falciparum
QIECLKLIASNKFSFKRIGY

SEQ ID NO: 3392064 - protein, 28 aa, Plasmodium falciparum
QIEDVLDKILPGKDLNLVTLKSVRKDVA

SEQ ID NO: 3392065 - protein, 42 aa, Plasmodium falciparum
QIENLLKKFHITKYDYKITHFLIDIIQNESLKILKNAKHIKK

SEQ ID NO: 3392066 - protein, 31 aa, Plasmodium falciparum
QIGTLNNKMGEFFFPFQKRHSTLHSRSSIKN

SEQ ID NO: 3392067 - protein, 47 aa, Plasmodium falciparum
QIIDNVCKILTKPKWKPFFMKLNIYHVLALWLMPTSKNTLPNFTIRT

SEQ ID NO: 3392068 - protein, 28 aa, Plasmodium falciparum
QIIDPLNFLRSFFNFNKLSYKKLIGCIT

SEQ ID NO: 3392069 - protein, 24 aa, Plasmodium falciparum
QIIKQYIHIFNLLNQIKTLIKNVE

SEQ ID NO: 3392070 - protein, 27 aa, Plasmodium falciparum
QIIKVKYNIHKISWSPNGTILAIACSD

SEQ ID NO: 3392071 - protein, 18 aa, Plasmodium falciparum
QIILGMNGYIWISSPIKK

SEQ ID NO: 3392072 - protein, 20 aa, Plasmodium falciparum
QIIPGVLFIDEVHMLDIECF

SEQ ID NO: 3392073 - protein, 17 aa, Plasmodium falciparum
QIIQNYFYTVYENKERQ

SEQ ID NO: 3392074 - protein, 48 aa, Plasmodium falciparum
QIKANLQNNLILLYNIYDMYIKGNFRIIKIEDIYVKSFLSEDIRKKHI

SEQ ID NO: 3392075 - protein, 18 aa, Plasmodium falciparum
QIKEYLIRAIYIEMLGHD

SEQ ID NO: 3392076 - protein, 23 aa, Plasmodium falciparum
QIKKSYVHILNANKKQYLAVNLN

SEQ ID NO: 3392077 - protein, 25 aa, Plasmodium falciparum
QIKNKINFELLWNSNKIRTSFKNQI

SEQ ID NO: 3392078 - protein, 24 aa, Plasmodium falciparum
QIKQKELLLYPFEEELKISRERNK

SEQ ID NO: 3392079 - protein, 17 aa, Plasmodium falciparum
QIKSYLLGNPFIKIALN

SEQ ID NO: 3392080 - protein, 29 aa, Plasmodium falciparum
QILDLTILREYLLKDLFFDTSFNMERCLD

SEQ ID NO: 3392081 - protein, 17 aa, Plasmodium falciparum
QIMCPYNKKKDIFNNDV

SEQ ID NO: 3392082 - protein, 32 aa, Plasmodium falciparum
QIMLQRIKKEKKLLYFYLNSLERTVASLKNNE

SEQ ID NO: 3392083 - protein, 43 aa, Plasmodium falciparum
QIMNMNNEKYLQWFDTIYTVCVKLDDLCCRLSGTFPHSMNIWE

SEQ ID NO: 3392084 - protein, 25 aa, Plasmodium falciparum
QINKQMYTELLSAQLNNSIKYINTL

SEQ ID NO: 3392085 - protein, 30 aa, Plasmodium falciparum
QINNCYEDHFPFFLLPKEDSMILENMELYL

SEQ ID NO: 3392086 - protein, 26 aa, Plasmodium falciparum
QINQFKKYFNLFYVNENIMEILQNQF

SEQ ID NO: 3392087 - protein, 35 aa, Plasmodium falciparum
QINTDRHITFKHIIKTPLYLYKSKEDKNKNNSNNN

SEQ ID NO: 3392088 - protein, 24 aa, Plasmodium falciparum
QIPHINSPYFNDYMKRFSSINNGI

SEQ ID NO: 3392089 - protein, 32 aa, Plasmodium falciparum
QIQAYEYLLEYDNALLIYKNMCLKCNIKPDEK

SEQ ID NO: 3392090 - protein, 36 aa, Plasmodium falciparum
QIQFFNDHIQNIQWVQLLPLSYIKGNHINFFSINKI

SEQ ID NO: 3392091 - protein, 20 aa, Plasmodium falciparum
QIRHMVAILFLVGKGLLDNN

SEQ ID NO: 3392092 - protein, 24 aa, Plasmodium falciparum
QISFNSILYIPGSLPWELSKNMFD

SEQ ID NO: 3392093 - protein, 19 aa, Plasmodium falciparum
QISPFLLSFYTFYEYYDTN

SEQ ID NO: 3392094 - protein, 18 aa, Plasmodium falciparum
QISPYSFNIWKQLADRYE

SEQ ID NO: 3392095 - protein, 24 aa, Plasmodium falciparum
QISTHIIIHLLTFTFHKPEEDEHM

SEQ ID NO: 3392096 - protein, 25 aa, Plasmodium falciparum
QITSTHNLLVDVLLAAKHEGKSLVD

SEQ ID NO: 3392097 - protein, 21 aa, Plasmodium falciparum
QITYEIVAVIEFNRVMKLKKT

SEQ ID NO: 3392098 - protein, 29 aa, Plasmodium falciparum
QIVHFQNVFKVLYKLLSNISFHPNEEKYK

SEQ ID NO: 3392099 - protein, 24 aa, Plasmodium falciparum
QIYDEPFIILLKQIQNLLIFKKEI

SEQ ID NO: 3392100 - protein, 21 aa, Plasmodium falciparum
QIYGTFNRAILRKFPQSSHMA

SEQ ID NO: 3392101 - protein, 17 aa, Plasmodium falciparum
QIYNYNKSGNFNNFSRG

SEQ ID NO: 3392102 - protein, 36 aa, Plasmodium falciparum
QKAKKGMRFLSFPNICIFLLKRFTFDLQRMETVKLN

SEQ ID NO: 3392103 - protein, 21 aa, Plasmodium falciparum
QKCLQILTKILYLINKGDDIL

SEQ ID NO: 3392104 - protein, 24 aa, Plasmodium falciparum
QKCNNYFLNLKELQNIYASEKYGK

SEQ ID NO: 3392105 - protein, 24 aa, Plasmodium falciparum
QKDDSNIALLYNNKPNIDFNNFQL

SEQ ID NO: 3392106 - protein, 24 aa, Plasmodium falciparum
QKDLLKWHLCNNIKKLSMKRSDYK

SEQ ID NO: 3392107 - protein, 25 aa, Plasmodium falciparum
QKDQILLIDALLLYSSQQTKYNQLF

SEQ ID NO: 3392108 - protein, 25 aa, Plasmodium falciparum
QKDVNIFRMDTFYNNIFDSRNHMDK

SEQ ID NO: 3392109 - protein, 25 aa, Plasmodium falciparum
QKEKDFVEHFITILKNHLNEDNNFV

SEQ ID NO: 3392110 - protein, 35 aa, Plasmodium falciparum
QKELTCPICLDYFYLPVTMNCGHTFCRYCIGHNKL

SEQ ID NO: 3392111 - protein, 25 aa, Plasmodium falciparum
QKEYFKLYQVIEYIEKNVLLYGEYD

SEQ ID NO: 3392112 - protein, 25 aa, Plasmodium falciparum
QKEYRNVRIICILIGIREILNRVDY

SEQ ID NO: 3392113 - protein, 24 aa, Plasmodium falciparum
QKFELWDLGMLLPYKKDIGSKEIT

SEQ ID NO: 3392114 - protein, 18 aa, Plasmodium falciparum
QKFIIGSSYRKCDLVIKG

SEQ ID NO: 3392115 - protein, 25 aa, Plasmodium falciparum
QKFNIAFICYFLLHKINKCIHILLS

SEQ ID NO: 3392116 - protein, 18 aa, Plasmodium falciparum
QKFSLSDLYINQKYNFLI

SEQ ID NO: 3392117 - protein, 19 aa, Plasmodium falciparum
QKFYALQAERLCKLKKIYQ

SEQ ID NO: 3392118 - protein, 27 aa, Plasmodium falciparum
QKGLYFFNKRVQIFSLLDFLYKIDNDN

SEQ ID NO: 3392119 - protein, 18 aa, Plasmodium falciparum
QKGMMMTLTCDHRHIYGS

SEQ ID NO: 3392120 - protein, 25 aa, Plasmodium falciparum
QKHKFIYDILYASFIKKYKGILWLS

SEQ ID NO: 3392121 - protein, 24 aa, Plasmodium falciparum
QKHKPNVWLLNTGWIYGSYGSDNG

SEQ ID NO: 3392122 - protein, 24 aa, Plasmodium falciparum
QKIEPQYYIPVIPTILVNGCEGIG

SEQ ID NO: 3392123 - protein, 22 aa, Plasmodium falciparum
QKIKKPFILCKKNIIAIHKDKY

SEQ ID NO: 3392124 - protein, 17 aa, Plasmodium falciparum
QKINVSAQCKGILLSTV

SEQ ID NO: 3392125 - protein, 26 aa, Plasmodium falciparum
QKIREVELALLLRKRLQPYVDGDVEW

SEQ ID NO: 3392126 - protein, 20 aa, Plasmodium falciparum
QKISSIEKQLILLKLEKANK

SEQ ID NO: 3392127 - protein, 27 aa, Plasmodium falciparum
QKKEDWDYILFLYTSNNKMIYMNNYTK

SEQ ID NO: 3392128 - protein, 38 aa, Plasmodium falciparum
QKKIENFECKMLYNVLIDNFLLHIRKKIEKKLPMKPNM

SEQ ID NO: 3392129 - protein, 24 aa, Plasmodium falciparum
QKKIHFKNIPLFNYSKYKFTLENT

SEQ ID NO: 3392130 - protein, 27 aa, Plasmodium falciparum
QKKKGYVQSLIYSFNKKSQKSINNKNN

SEQ ID NO: 3392131 - protein, 24 aa, Plasmodium falciparum
QKKLYIFFMAICLALNKFLNTQEE

SEQ ID NO: 3392132 - protein, 17 aa, Plasmodium falciparum
QKKNDHILIFDKGEKIE

SEQ ID NO: 3392133 - protein, 23 aa, Plasmodium falciparum
QKKSFDVILLNKMKLFLLHNQKH

SEQ ID NO: 3392134 - protein, 18 aa, Plasmodium falciparum
QKKYPFNKLFLEELEKDE

SEQ ID NO: 3392135 - protein, 31 aa, Plasmodium falciparum
QKLFKEKIITLLKYFFIFLSNKVIQKNLLES

SEQ ID NO: 3392136 - protein, 22 aa, Plasmodium falciparum
QKLFNQIKIPELYIQKLGLNFS

SEQ ID NO: 3392137 - protein, 17 aa, Plasmodium falciparum
QKLIILIGPPGCGKTFL

SEQ ID NO: 3392138 - protein, 21 aa, Plasmodium falciparum
QKLKCKIIPDNYNNLSYSQNI

SEQ ID NO: 3392139 - protein, 26 aa, Plasmodium falciparum
QKLKGESLILFLKNQIKMYKKELSIK

SEQ ID NO: 3392140 - protein, 24 aa, Plasmodium falciparum
QKLLDIFIKLIKLENIYELIENKL

SEQ ID NO: 3392141 - protein, 30 aa, Plasmodium falciparum
QKLQELNIKFNRPYDFLADMLKSDIHMEKI

SEQ ID NO: 3392142 - protein, 18 aa, Plasmodium falciparum
QKLREKETLIKSLTAEIS

SEQ ID NO: 3392143 - protein, 20 aa, Plasmodium falciparum
QKMEIMNLFKKIMHACDSLS

SEQ ID NO: 3392144 - protein, 20 aa, Plasmodium falciparum
QKMEYEILCRWLHNKFSHKV

SEQ ID NO: 3392145 - protein, 31 aa, Plasmodium falciparum
QKMNNFEIFIIKIIDIIPKCFKIYASDFTLH

SEQ ID NO: 3392146 - protein, 26 aa, Plasmodium falciparum
QKNEKLHKNFGKLPNYILKKKKDVSQ

SEQ ID NO: 3392147 - protein, 19 aa, Plasmodium falciparum
QKNEYFDLDLFKYLSTLTE

SEQ ID NO: 3392148 - protein, 33 aa, Plasmodium falciparum
QKNFYIDITFKQFIFRLHIFTSIIIQKYLIQIT

SEQ ID NO: 3392149 - protein, 25 aa, Plasmodium falciparum
QKNILTHAINIFKTAKIFIYSTCSF

SEQ ID NO: 3392150 - protein, 23 aa, Plasmodium falciparum
QKNITYVPGLYKIFDEIIVNAAD

SEQ ID NO: 3392151 - protein, 27 aa, Plasmodium falciparum
QKNKVLLHLIDFILNKLFENNLNYRYK

SEQ ID NO: 3392152 - protein, 24 aa, Plasmodium falciparum
QKNNFNILEIYEILNMKKPQVEND

SEQ ID NO: 3392153 - protein, 24 aa, Plasmodium falciparum
QKNSYNLKLINFYKLEINKLRESL

SEQ ID NO: 3392154 - protein, 18 aa, Plasmodium falciparum
QKNVAYANTIIKGGRNLR

SEQ ID NO: 3392155 - protein, 28 aa, Plasmodium falciparum
QKQKIMKILMFKLYEYIKKSKKTYRMLN

SEQ ID NO: 3392156 - protein, 23 aa, Plasmodium falciparum
QKRKLYELKIRKDFEEKIRLRRE

SEQ ID NO: 3392157 - protein, 34 aa, Plasmodium falciparum
QKSCKILNIKYKDVIYSEFFRLSSKRKKNCNELL

SEQ ID NO: 3392158 - protein, 24 aa, Plasmodium falciparum
QKSKLALAILAYKNPNVLILDEPS

SEQ ID NO: 3392159 - protein, 30 aa, Plasmodium falciparum
QKSPHKIYCFIHFFNYDECLRALTEMNGYI

SEQ ID NO: 3392160 - protein, 44 aa, Plasmodium falciparum
QKSPSLSINPYNFLSCSLPTPPPQLPHTGPLSMTSLDPHFMSTG

SEQ ID NO: 3392161 - protein, 25 aa, Plasmodium falciparum
QKSTDLLIRKLPFQRLVREIAQDYK

SEQ ID NO: 3392162 - protein, 24 aa, Plasmodium falciparum
QKSTDLLIRKLPFQRLVREIAQEY

SEQ ID NO: 3392163 - protein, 23 aa, Plasmodium falciparum
QKSYLNYYIAHFGAVNRIKINKF

SEQ ID NO: 3392164 - protein, 25 aa, Plasmodium falciparum
QKTDKILLWLGANVMVEFPFDEATD

SEQ ID NO: 3392165 - protein, 17 aa, Plasmodium falciparum
QKTKEIFTSPSGKRRGG

SEQ ID NO: 3392166 - protein, 29 aa, Plasmodium falciparum
QKTYNLICLKCLIAVIIKFEDNIIKFKEI

SEQ ID NO: 3392167 - protein, 20 aa, Plasmodium falciparum
QKVAAILKNAGARKIYLYAT

SEQ ID NO: 3392168 - protein, 22 aa, Plasmodium falciparum
QKVLSINIYLQKYLESNQFEKN

SEQ ID NO: 3392169 - protein, 19 aa, Plasmodium falciparum
QKVLTLSNQLPLLSFVTFN

SEQ ID NO: 3392170 - protein, 17 aa, Plasmodium falciparum
QKVLTPEEKQKLNRPPT

SEQ ID NO: 3392171 - protein, 24 aa, Plasmodium falciparum
QKVLYPYYYELVLKEKLITDINMI

SEQ ID NO: 3392172 - protein, 31 aa, Plasmodium falciparum
QKVNAKLMLNKYLNVINYLMKENINLKKKIE

SEQ ID NO: 3392173 - protein, 23 aa, Plasmodium falciparum
QKYESIWLQYKTLWQIEIGDIIS

SEQ ID NO: 3392174 - protein, 22 aa, Plasmodium falciparum
QKYGYFSWLWKYFQPKKTEVKK

SEQ ID NO: 3392175 - protein, 18 aa, Plasmodium falciparum
QKYIPHMELLLNACKQVN

SEQ ID NO: 3392176 - protein, 27 aa, Plasmodium falciparum
QKYKNINYFFKYTHGLKGISIYNANRL

SEQ ID NO: 3392177 - protein, 24 aa, Plasmodium falciparum
QKYTYKLHIIINKKDQYELSKMIS

SEQ ID NO: 3392178 - protein, 23 aa, Plasmodium falciparum
QLAYFLEINLVDIVFGPPTLGLH

SEQ ID NO: 3392179 - protein, 17 aa, Plasmodium falciparum
QLDFLYTNSFINQDALC

SEQ ID NO: 3392180 - protein, 24 aa, Plasmodium falciparum
QLDNLDFFELLKCYHSLNIQQIQI

SEQ ID NO: 3392181 - protein, 22 aa, Plasmodium falciparum
QLEMFDQIIKYPEPFSISEVFK

SEQ ID NO: 3392182 - protein, 42 aa, Plasmodium falciparum
QLENKLIKYYEYLQIIKEDLYGYKKLLYDFKINEKHVVNRFK

SEQ ID NO: 3392183 - protein, 17 aa, Plasmodium falciparum
QLFNNKTWKEIKLNKFD

SEQ ID NO: 3392184 - protein, 24 aa, Plasmodium falciparum
QLHLTGVCFMTVLYNFIIVEGKHV

SEQ ID NO: 3392185 - protein, 24 aa, Plasmodium falciparum
QLHVHDIKIFFIPKIYKENEEDNK

SEQ ID NO: 3392186 - protein, 18 aa, Plasmodium falciparum
QLIDKLDSVYLILDEIAD

SEQ ID NO: 3392187 - protein, 23 aa, Plasmodium falciparum
QLIKNLIILINHLTTRPSKEWFD

SEQ ID NO: 3392188 - protein, 17 aa, Plasmodium falciparum
QLILITHDNYFVDILSQ

SEQ ID NO: 3392189 - protein, 24 aa, Plasmodium falciparum
QLINTYIYCWFNKDVPYKVKHHML

SEQ ID NO: 3392190 - protein, 26 aa, Plasmodium falciparum
QLIQDEGMIFLWVTGRAMELARECLQ

SEQ ID NO: 3392191 - protein, 21 aa, Plasmodium falciparum
QLIRYSLYEFMKNTQMLILDK

SEQ ID NO: 3392192 - protein, 20 aa, Plasmodium falciparum
QLKIHNIYYLSALTGENVEK

SEQ ID NO: 3392193 - protein, 17 aa, Plasmodium falciparum
QLKMIRKDYLHALVIWF

SEQ ID NO: 3392194 - protein, 26 aa, Plasmodium falciparum
QLKYQNWLLHSCMLWFKCKGETFRFK

SEQ ID NO: 3392195 - protein, 18 aa, Plasmodium falciparum
QLLAKLCSFFNNTFNIKK

SEQ ID NO: 3392196 - protein, 21 aa, Plasmodium falciparum
QLLFNHIPVGVGSQGFILCNQ

SEQ ID NO: 3392197 - protein, 20 aa, Plasmodium falciparum
QLLHKRFVKYRNKKLKKIMD

SEQ ID NO: 3392198 - protein, 17 aa, Plasmodium falciparum
QLLKDIEKLWIYLQNMY

SEQ ID NO: 3392199 - protein, 30 aa, Plasmodium falciparum
QLLNCNNSYFRFYLLNGLSISIHHLEMKST

SEQ ID NO: 3392200 - protein, 18 aa, Plasmodium falciparum
QLLPFFISSNYLYKNNKI

SEQ ID NO: 3392201 - protein, 20 aa, Plasmodium falciparum
QLLRIMERLNLKILSIKPSN

SEQ ID NO: 3392202 - protein, 31 aa, Plasmodium falciparum
QLMDWACIIAKKRKYPYWKTFSTGKLRKNGG

SEQ ID NO: 3392203 - protein, 19 aa, Plasmodium falciparum
QLMNSFKYPVMVKVIFHRN

SEQ ID NO: 3392204 - protein, 25 aa, Plasmodium falciparum
QLNENNYLTLLSLRYNYFSSVKELI

SEQ ID NO: 3392205 - protein, 18 aa, Plasmodium falciparum
QLNFYNGKYMFMINYVFC

SEQ ID NO: 3392206 - protein, 23 aa, Plasmodium falciparum
QLNKSTGMDVFLKKQSYTKNDDS

SEQ ID NO: 3392207 - protein, 21 aa, Plasmodium falciparum
QLNVRIVSFPSWTLFKKQPED

SEQ ID NO: 3392208 - protein, 31 aa, Plasmodium falciparum
QLQFEPSLLSRFDLIFLVRDSATEQDDERIA

SEQ ID NO: 3392209 - protein, 19 aa, Plasmodium falciparum
QLQLINEGIIHEFLRMYWC

SEQ ID NO: 3392210 - protein, 17 aa, Plasmodium falciparum
QLRITSFFKRIDKKTNE

SEQ ID NO: 3392211 - protein, 27 aa, Plasmodium falciparum
QLRKIVNHPYLFLYDYNIDENIIKCSG

SEQ ID NO: 3392212 - protein, 33 aa, Plasmodium falciparum
QLRLQKVSLGLLAYFAYHRLGIISMTASGFDSL

SEQ ID NO: 3392213 - protein, 42 aa, Plasmodium falciparum
QLRSASCETLMFVKEDVILPNYITFYELIKNKAQGKTGPLFS

SEQ ID NO: 3392214 - protein, 27 aa, Plasmodium falciparum
QLSFNDDVFIFLDYYTKKHSNSNYKKN

SEQ ID NO: 3392215 - protein, 17 aa, Plasmodium falciparum
QLSLIKESLEYGELLLS

SEQ ID NO: 3392216 - protein, 36 aa, Plasmodium falciparum
QLSYNVPYYIYELNKFVFIKFMKFEKYINKNHDIAN

SEQ ID NO: 3392217 - protein, 28 aa, Plasmodium falciparum
QLSYTELQSFFIDKINLLNQIGYITNEE

SEQ ID NO: 3392218 - protein, 17 aa, Plasmodium falciparum
QLWLFLKGAGMTLDENI

SEQ ID NO: 3392219 - protein, 17 aa, Plasmodium falciparum
QLYIQLFEIMKILIHNN

SEQ ID NO: 3392220 - protein, 23 aa, Plasmodium falciparum
QLYKSHIINNLFFQSPQNNNNNN

SEQ ID NO: 3392221 - protein, 19 aa, Plasmodium falciparum
QLYMINHIFYEIILINNHI

SEQ ID NO: 3392222 - protein, 18 aa, Plasmodium falciparum
QLYYFYGEKTKINKIILI

SEQ ID NO: 3392223 - protein, 19 aa, Plasmodium falciparum
QMEHTILLRPTCKEVLSRG

SEQ ID NO: 3392224 - protein, 18 aa, Plasmodium falciparum
QMFELCDRMIGIYKTNDI

SEQ ID NO: 3392225 - protein, 21 aa, Plasmodium falciparum
QMKISYPSLALIVFELKAYDT

SEQ ID NO: 3392226 - protein, 31 aa, Plasmodium falciparum
QMNSPYNPAPSIPIKLFVSSIPKNLTEEDIK

SEQ ID NO: 3392227 - protein, 24 aa, Plasmodium falciparum
QMPLQLFKIKLLYNYNKINLNLIQ

SEQ ID NO: 3392228 - protein, 18 aa, Plasmodium falciparum
QMRGTSFVVLLNILSKRL

SEQ ID NO: 3392229 - protein, 25 aa, Plasmodium falciparum
QMTERAMELLLLPDSPCLLLDIGCG

SEQ ID NO: 3392230 - protein, 17 aa, Plasmodium falciparum
QMTQLIEHLYGLKMKLQ

SEQ ID NO: 3392231 - protein, 40 aa, Plasmodium falciparum
QMVRKCHRIILGLLPHSQPAWKNAFFLLDNKYGGILHIHG

SEQ ID NO: 3392232 - protein, 18 aa, Plasmodium falciparum
QMYINNMFKMAAQQSVQN

SEQ ID NO: 3392233 - protein, 17 aa, Plasmodium falciparum
QMYNDYINMYGNKKKKD

SEQ ID NO: 3392234 - protein, 24 aa, Plasmodium falciparum
QNAEYAFLLLDYPAYNNSIGHPSP

SEQ ID NO: 3392235 - protein, 23 aa, Plasmodium falciparum
QNAKDLCIFLFIVRNINAIHSFC

SEQ ID NO: 3392236 - protein, 26 aa, Plasmodium falciparum
QNDDNFFVIPNCIFDEKFPGLQKKTE

SEQ ID NO: 3392237 - protein, 24 aa, Plasmodium falciparum
QNDKIIHFCIFKFIYYMCMDILYN

SEQ ID NO: 3392238 - protein, 17 aa, Plasmodium falciparum
QNDLIVTTPLKNILQIN

SEQ ID NO: 3392239 - protein, 27 aa, Plasmodium falciparum
QNDNLNNICILPLNPNIQQHSFNYNMN

SEQ ID NO: 3392240 - protein, 20 aa, Plasmodium falciparum
QNDWKCVIAVILNSKESIKY

SEQ ID NO: 3392241 - protein, 21 aa, Plasmodium falciparum
QNEDFIFHPNDFFNNDNFNNY

SEQ ID NO: 3392242 - protein, 20 aa, Plasmodium falciparum
QNEHFDMLGKLLMSDMKSLF

SEQ ID NO: 3392243 - protein, 26 aa, Plasmodium falciparum
QNELFKIDFNNLVKKKKKLLQDLELI

SEQ ID NO: 3392244 - protein, 25 aa, Plasmodium falciparum
QNENYYYQYLNYPHVANFNMMMNTT

SEQ ID NO: 3392245 - protein, 23 aa, Plasmodium falciparum
QNFNEQFFVQQTNFNYINDNINN

SEQ ID NO: 3392246 - protein, 26 aa, Plasmodium falciparum
QNFTTLQNFLFKIDVEFVEYKNFVLL

SEQ ID NO: 3392247 - protein, 32 aa, Plasmodium falciparum
QNFVTLYNRKLLLNFLLKLHYLKYQEQFMKTY

SEQ ID NO: 3392248 - protein, 28 aa, Plasmodium falciparum
QNGIVQLSLLELFTIINEKKCRNIKVLM

SEQ ID NO: 3392249 - protein, 46 aa, Plasmodium falciparum
QNGNQKRQYFPVKKFGQAQAKYLAIYARIQAVNCLQRKPHKPRMSK

SEQ ID NO: 3392250 - protein, 21 aa, Plasmodium falciparum
QNGSITLLYLKKYYNKKNNNE

SEQ ID NO: 3392251 - protein, 36 aa, Plasmodium falciparum
QNHEYIYYRIFVNNHILQYLPILMSLNENVDLNVNM

SEQ ID NO: 3392252 - protein, 28 aa, Plasmodium falciparum
QNHKPYFNNMYKYIFKKYIDLSTNYWGA

SEQ ID NO: 3392253 - protein, 27 aa, Plasmodium falciparum
QNHLGKNYILILYKVLLSMYKKKMAIY

SEQ ID NO: 3392254 - protein, 30 aa, Plasmodium falciparum
QNHNASPFFKYIYFKYINKDKNNFYPVFIN

SEQ ID NO: 3392255 - protein, 28 aa, Plasmodium falciparum
QNICNDKDIILFKYKQEEKNLLQLIDSY

SEQ ID NO: 3392256 - protein, 23 aa, Plasmodium falciparum
QNIEIRLIYFNYSKELIIHLNTF

SEQ ID NO: 3392257 - protein, 33 aa, Plasmodium falciparum
QNIEWKNYLNKINTYPILLSLLSIEEYNNIKLQ

SEQ ID NO: 3392258 - protein, 26 aa, Plasmodium falciparum
QNIIHKIIKMKINLYQPLTIYDVLAF

SEQ ID NO: 3392259 - protein, 25 aa, Plasmodium falciparum
QNINEYFYYSFLIDIEYSNLLHMKK

SEQ ID NO: 3392260 - protein, 26 aa, Plasmodium falciparum
QNKEYILNNFTQKIFNIITYLKNNDE

SEQ ID NO: 3392261 - protein, 22 aa, Plasmodium falciparum
QNKFKKMINRNNNNNFSNIRQG

SEQ ID NO: 3392262 - protein, 21 aa, Plasmodium falciparum
QNKFLYINDYLKNSIIHDSQD

SEQ ID NO: 3392263 - protein, 22 aa, Plasmodium falciparum
QNKITFDIFIKNDIMKGLVALV

SEQ ID NO: 3392264 - protein, 25 aa, Plasmodium falciparum
QNKKKYICNYISQHKKRIKEKKSNL

SEQ ID NO: 3392265 - protein, 23 aa, Plasmodium falciparum
QNKKYKNHYYDNVKFDLSYEIEE

SEQ ID NO: 3392266 - protein, 22 aa, Plasmodium falciparum
QNKLHIDTFEKYKYLICENINN

SEQ ID NO: 3392267 - protein, 25 aa, Plasmodium falciparum
QNKLQKLLDEIKSLDLEKFQLTQTL

SEQ ID NO: 3392268 - protein, 32 aa, Plasmodium falciparum
QNKNYILELAEQIYYEYFQRGLIKNDHNFHLN

SEQ ID NO: 3392269 - protein, 23 aa, Plasmodium falciparum
QNKRNIFIKFEPFIIHVKCTTFL

SEQ ID NO: 3392270 - protein, 24 aa, Plasmodium falciparum
QNLISNPILYLLRIKISKYNKSLT

SEQ ID NO: 3392271 - protein, 19 aa, Plasmodium falciparum
QNLYKNVLNINDLNLPTID

SEQ ID NO: 3392272 - protein, 24 aa, Plasmodium falciparum
QNMHIYNMFAQFNELNFNDMFNFS

SEQ ID NO: 3392273 - protein, 23 aa, Plasmodium falciparum
QNMKPTILPTYINKDQIQKHKSD

SEQ ID NO: 3392274 - protein, 22 aa, Plasmodium falciparum
QNMSQNIIYHNKVDYLNENDSN

SEQ ID NO: 3392275 - protein, 23 aa, Plasmodium falciparum
QNNDIDLIMEKKLYNGPTSNNTK

SEQ ID NO: 3392276 - protein, 22 aa, Plasmodium falciparum
QNNENVPMCLISKSSYSEVNDE

SEQ ID NO: 3392277 - protein, 37 aa, Plasmodium falciparum
QNNIQYAPPNYYGNYLYYYAAPYGYGPVGLPEKVVHN

SEQ ID NO: 3392278 - protein, 19 aa, Plasmodium falciparum
QNNIYMNQNKYFNNKDFNI

SEQ ID NO: 3392279 - protein, 42 aa, Plasmodium falciparum
QNNKSLWKLPWNSIKKDSFYFKGRFFKIIPNEGWSEIKELSK

SEQ ID NO: 3392280 - protein, 17 aa, Plasmodium falciparum
QNNKSYDILNDSNFNIL

SEQ ID NO: 3392281 - protein, 23 aa, Plasmodium falciparum
QNNLNMNIFLNAINAMYFATMKK

SEQ ID NO: 3392282 - protein, 26 aa, Plasmodium falciparum
QNNMINLGFHDGFGTNGLMKTQLNNQ

SEQ ID NO: 3392283 - protein, 28 aa, Plasmodium falciparum
QNNMSFNNLMWNNYYQDISGGTTFNSNN

SEQ ID NO: 3392284 - protein, 25 aa, Plasmodium falciparum
QNNTIMKKNKNSVLFNCYHNEDEEE

SEQ ID NO: 3392285 - protein, 35 aa, Plasmodium falciparum
QNNTLILVDPFYDPIKVLYPFKIYEKKINVHYCPL

SEQ ID NO: 3392286 - protein, 26 aa, Plasmodium falciparum
QNNYIVEKFPCYFISHANGIALSCDA

SEQ ID NO: 3392287 - protein, 23 aa, Plasmodium falciparum
QNNYLNQFLELYIKNNSINNEAF

SEQ ID NO: 3392288 - protein, 23 aa, Plasmodium falciparum
QNPEYWCYYFSSKAKDHLYSFGL

SEQ ID NO: 3392289 - protein, 25 aa, Plasmodium falciparum
QNQIQMLSCKFLLKKMKKAKSEEQA

SEQ ID NO: 3392290 - protein, 20 aa, Plasmodium falciparum
QNQMFPYADPNFCKNGRMRP

SEQ ID NO: 3392291 - protein, 34 aa, Plasmodium falciparum
QNRISELYSLIRFIEFYPYAYYFCSKKDCKCLLL

SEQ ID NO: 3392292 - protein, 26 aa, Plasmodium falciparum
QNRMNLFIPINKYNGKRYKIYFNESN

SEQ ID NO: 3392293 - protein, 21 aa, Plasmodium falciparum
QNTINIIKNYSFLYPSKNNNN

SEQ ID NO: 3392294 - protein, 35 aa, Plasmodium falciparum
QNTLKTIIQFMKPKHFVLLPTYNSYYSFHLEMLLH

SEQ ID NO: 3392295 - protein, 29 aa, Plasmodium falciparum
QNTSYKLYYKLLLFLNLRFDVYSNNQFFI

SEQ ID NO: 3392296 - protein, 20 aa, Plasmodium falciparum
QNVDFLYDGPKYELIFIAKG

SEQ ID NO: 3392297 - protein, 26 aa, Plasmodium falciparum
QNVKHTKLFNMLISLKNENSSINKSI

SEQ ID NO: 3392298 - protein, 29 aa, Plasmodium falciparum
QNVTQTIILLKRIVILITAISKLKKKAIK

SEQ ID NO: 3392299 - protein, 42 aa, Plasmodium falciparum
QNYFKILNYKIQITKDILLFDRLYQICPSPFTFGKCLFIGNH

SEQ ID NO: 3392300 - protein, 35 aa, Plasmodium falciparum
QNYSLSFCAHLFLIRALLQYPCFLKTFLNYNNFKA

SEQ ID NO: 3392301 - protein, 30 aa, Plasmodium falciparum
QNYYIILRNIDKALFLFKFLNTMVNDNETV

SEQ ID NO: 3392302 - protein, 28 aa, Plasmodium falciparum
QPCDGQLIILIHFHLKRYIMVGKKKTLD

SEQ ID NO: 3392303 - protein, 17 aa, Plasmodium falciparum
QPFILKKGKEQNVNDMN

SEQ ID NO: 3392304 - protein, 23 aa, Plasmodium falciparum
QPINQIFRFFTNKTVVQIWLYDK

SEQ ID NO: 3392305 - protein, 25 aa, Plasmodium falciparum
QPISLHELIKYFQIFDNENKGYMDM

SEQ ID NO: 3392306 - protein, 23 aa, Plasmodium falciparum
QPKGVLLYGPPGTGKTLLARAVA

SEQ ID NO: 3392307 - protein, 27 aa, Plasmodium falciparum
QPLGQAINYQVIPPPQTIGQQLAEPIN

SEQ ID NO: 3392308 - protein, 20 aa, Plasmodium falciparum
QPQIPLTLQPMQNPPHAMAP

SEQ ID NO: 3392309 - protein, 20 aa, Plasmodium falciparum
QPSVYLFLIDVTVTSVNSGL

SEQ ID NO: 3392310 - protein, 28 aa, Plasmodium falciparum
QQAADTCFRYFLHKFSLKDSMGLNIDES

SEQ ID NO: 3392311 - protein, 25 aa, Plasmodium falciparum
QQDKASFNLLLKKRIKQMNKQTENT

SEQ ID NO: 3392312 - protein, 25 aa, Plasmodium falciparum
QQENLFYDSYLIYCNFDLSSIYNIG

SEQ ID NO: 3392313 - protein, 24 aa, Plasmodium falciparum
QQFESLMVTFLRKYKIKANEKNIY

SEQ ID NO: 3392314 - protein, 32 aa, Plasmodium falciparum
QQFLNTHKNYKLNWIFPNNFPDREVYKCFKYP

SEQ ID NO: 3392315 - protein, 32 aa, Plasmodium falciparum
QQFPCIYNCVTINWFLKWPLEALVNVSTAYLN

SEQ ID NO: 3392316 - protein, 26 aa, Plasmodium falciparum
QQHTKKNLLLLIKSFAYKGIKLENIS

SEQ ID NO: 3392317 - protein, 20 aa, Plasmodium falciparum
QQHYFNCPYQITFMPSNFSN

SEQ ID NO: 3392318 - protein, 17 aa, Plasmodium falciparum
QQIFNLNKYLLTKEQMA

SEQ ID NO: 3392319 - protein, 27 aa, Plasmodium falciparum
QQKENDILKMKLYIEKLKLSEKNLKDK

SEQ ID NO: 3392320 - protein, 19 aa, Plasmodium falciparum
QQNIALLKTEGIDLKFTDD

SEQ ID NO: 3392321 - protein, 26 aa, Plasmodium falciparum
QQQHKYFHHNFFYLKNLNNSENIIIP

SEQ ID NO: 3392322 - protein, 27 aa, Plasmodium falciparum
QQRKYKYYIDIMKKYNLNLNLKTNNLN

SEQ ID NO: 3392323 - protein, 17 aa, Plasmodium falciparum
QQRLADYLELDDSYMSD

SEQ ID NO: 3392324 - protein, 25 aa, Plasmodium falciparum
QQSLRRIMELYSDTTRFALACNQSE

SEQ ID NO: 3392325 - protein, 26 aa, Plasmodium falciparum
QQYKDELLYLRFWGIIKGTHNDYYIL

SEQ ID NO: 3392326 - protein, 28 aa, Plasmodium falciparum
QRAFKKYMKKKYILYCLKIAHVKDSKKK

SEQ ID NO: 3392327 - protein, 25 aa, Plasmodium falciparum
QRCEISSMILLLKSLGMDDIINFDF

SEQ ID NO: 3392328 - protein, 30 aa, Plasmodium falciparum
QRDNKYSDLYEKYIKLIKSICMIINIECCD

SEQ ID NO: 3392329 - protein, 27 aa, Plasmodium falciparum
QREEQMNLFIKLKDKYDIIFQKKIELT

SEQ ID NO: 3392330 - protein, 36 aa, Plasmodium falciparum
QRELGFWRSKIIKYRNRFLLAHRKDLQPFVNPRVFS

SEQ ID NO: 3392331 - protein, 18 aa, Plasmodium falciparum
QRFRIPLNEFASSLFLCD

SEQ ID NO: 3392332 - protein, 24 aa, Plasmodium falciparum
QRINSIPNFFKANLLFCVSRQDHL

SEQ ID NO: 3392333 - protein, 24 aa, Plasmodium falciparum
QRIQNINIFIKKILIDKIEVEKHL

SEQ ID NO: 3392334 - protein, 24 aa, Plasmodium falciparum
QRIREACILGRKTLDYAHTLVSPG

SEQ ID NO: 3392335 - protein, 21 aa, Plasmodium falciparum
QRLGRTIIPLNPELLAQSTFD

SEQ ID NO: 3392336 - protein, 24 aa, Plasmodium falciparum
QRLIKTYFTMCPNYYFTGDGAFRD

SEQ ID NO: 3392337 - protein, 28 aa, Plasmodium falciparum
QRLKNYSAYMLVYVKKSLIPKLIKECDP

SEQ ID NO: 3392338 - protein, 80 aa, Plasmodium falciparum
QRNCEIENAFMILKDKIKTTNVEYLKLLNKIMEGLLEHENFYKSIKQFLKKYYVYNDIYIDEEFFHDFLLEEEDNNYEIQ

SEQ ID NO: 3392339 - protein, 21 aa, Plasmodium falciparum
QRNFNKNNFKYVIGQNLHRDD

SEQ ID NO: 3392340 - protein, 17 aa, Plasmodium falciparum
QRNLNMKYQLLKNKQDK

SEQ ID NO: 3392341 - protein, 29 aa, Plasmodium falciparum
QRNYNTKQFLLLIDPFFKIICMTDQKYVM

SEQ ID NO: 3392342 - protein, 19 aa, Plasmodium falciparum
QRQKIIWKKWIAKHPNKMN

SEQ ID NO: 3392343 - protein, 20 aa, Plasmodium falciparum
QRRCDYFSLLNNFINLLISV

SEQ ID NO: 3392344 - protein, 20 aa, Plasmodium falciparum
QRTFREIIFLYELNGHDNII

SEQ ID NO: 3392345 - protein, 20 aa, Plasmodium falciparum
QRVEHIVHIFTQASDYAYST

SEQ ID NO: 3392346 - protein, 23 aa, Plasmodium falciparum
QSCQQSCFYKYSPNYAKSNSNID

SEQ ID NO: 3392347 - protein, 24 aa, Plasmodium falciparum
QSDSICGIYRLNSSQLLNENLDNT

SEQ ID NO: 3392348 - protein, 23 aa, Plasmodium falciparum
QSEHNLLLLKNKKIDQLEKVNKN

SEQ ID NO: 3392349 - protein, 22 aa, Plasmodium falciparum
QSERFLLKRNIINDLYSKVDVQ

SEQ ID NO: 3392350 - protein, 32 aa, Plasmodium falciparum
QSEYTLYVPLKKKFYTFLIFQNQTKDIFEHID

SEQ ID NO: 3392351 - protein, 20 aa, Plasmodium falciparum
QSFENFRKLILQKIGKTNGD

SEQ ID NO: 3392352 - protein, 25 aa, Plasmodium falciparum
QSGKNIFIFYNLYMNQYKKKEDNEI

SEQ ID NO: 3392353 - protein, 40 aa, Plasmodium falciparum
QSHDIYRKELLSNKYLYDKNLYNYKKTYNIFSFSNNHIGE

SEQ ID NO: 3392354 - protein, 23 aa, Plasmodium falciparum
QSIKLPQGVFYQDSKKAFCANWY

SEQ ID NO: 3392355 - protein, 22 aa, Plasmodium falciparum
QSIQLIFKFDNPYIYKILCVSK

SEQ ID NO: 3392356 - protein, 17 aa, Plasmodium falciparum
QSLIGVYKNKHKKCSKT

SEQ ID NO: 3392357 - protein, 33 aa, Plasmodium falciparum
QSLKSNVILLLDSYFHIVIWYGEMIYQWREQGF

SEQ ID NO: 3392358 - protein, 21 aa, Plasmodium falciparum
QSLKYFLFPGDSKSINLNPSS

SEQ ID NO: 3392359 - protein, 17 aa, Plasmodium falciparum
QSLSIQITKLKQHIVFY

SEQ ID NO: 3392360 - protein, 41 aa, Plasmodium falciparum
QSLVKIYLNKFLDKKFRLSNWLNYSLLQEQILYAAVDAYAS

SEQ ID NO: 3392361 - protein, 37 aa, Plasmodium falciparum
QSNIKCINGYMIGIRWVPNVFAYEYYVYKITEDVKSD

SEQ ID NO: 3392362 - protein, 24 aa, Plasmodium falciparum
QSNKSIDDMIPYENLKKLNDLYNF

SEQ ID NO: 3392363 - protein, 18 aa, Plasmodium falciparum
QSNRFMRVKPAWRKPRGI

SEQ ID NO: 3392364 - protein, 23 aa, Plasmodium falciparum
QSNYKLIFLKHHKAPVMAVVVNN

SEQ ID NO: 3392365 - protein, 23 aa, Plasmodium falciparum
QSQKDYVYNYYNGTNKTMNNTTI

SEQ ID NO: 3392366 - protein, 26 aa, Plasmodium falciparum
QSRSEFIIKRVQLKLKLYCIRNNMNY

SEQ ID NO: 3392367 - protein, 28 aa, Plasmodium falciparum
QSSAVKDLLLLDVCPLSLGLETAGGVMT

SEQ ID NO: 3392368 - protein, 51 aa, Plasmodium falciparum
QSSDYNFLDHTKLSYKWDIWSMGCVFQEMMNLPSPFQHYIITFDESDQIYE

SEQ ID NO: 3392369 - protein, 24 aa, Plasmodium falciparum
QSSNQVIPYIYKKIYIVKSTYDQK

SEQ ID NO: 3392370 - protein, 17 aa, Plasmodium falciparum
QSSYFCSPAPSNSILRN

SEQ ID NO: 3392371 - protein, 21 aa, Plasmodium falciparum
QSTASNGLFTVIERKPLSSLE

SEQ ID NO: 3392372 - protein, 27 aa, Plasmodium falciparum
QSVLKKKNIIFLKKKIKLMKYIELYNI

SEQ ID NO: 3392373 - protein, 18 aa, Plasmodium falciparum
QSVPLIIGQFLDIIDNNY

SEQ ID NO: 3392374 - protein, 19 aa, Plasmodium falciparum
QTALHMLKLMLQKDYNKRP

SEQ ID NO: 3392375 - protein, 22 aa, Plasmodium falciparum
QTCLFDLQYNLPVQVRDKFLEN

SEQ ID NO: 3392376 - protein, 22 aa, Plasmodium falciparum
QTCVSCYQYIKEKVPSNKIFIE

SEQ ID NO: 3392377 - protein, 25 aa, Plasmodium falciparum
QTDITFLNNRFITWDSYFEDSEIQK

SEQ ID NO: 3392378 - protein, 34 aa, Plasmodium falciparum
QTEKGINYLKWINSNLLLFTSLNGNIYIYDIRSR

SEQ ID NO: 3392379 - protein, 30 aa, Plasmodium falciparum
QTEMFKLRLNLFCFSFLKSSKNIIKPDGYV

SEQ ID NO: 3392380 - protein, 21 aa, Plasmodium falciparum
QTFDDYYYMKAHGYDDSEYST

SEQ ID NO: 3392381 - protein, 27 aa, Plasmodium falciparum
QTFTKTCNVLIQRGYLSILKDTNNDFF

SEQ ID NO: 3392382 - protein, 22 aa, Plasmodium falciparum
QTGCRILQRILEKKNPKHIEEI

SEQ ID NO: 3392383 - protein, 23 aa, Plasmodium falciparum
QTGGVRPFGLSLLICGVDVYGYH

SEQ ID NO: 3392384 - protein, 27 aa, Plasmodium falciparum
QTIEELKNLVLFLNNENKRLHTMNMDS

SEQ ID NO: 3392385 - protein, 29 aa, Plasmodium falciparum
QTILYDKNTIPNYPYYTYNIIQDKCLKNE

SEQ ID NO: 3392386 - protein, 32 aa, Plasmodium falciparum
QTINIFRYIKENLPIYFFLNKMDINHIDIDSN

SEQ ID NO: 3392387 - protein, 19 aa, Plasmodium falciparum
QTIYDYLFQDILAAPPFSN

SEQ ID NO: 3392388 - protein, 26 aa, Plasmodium falciparum
QTKIKNFLLDFYFGTGLKPKSIVSYN

SEQ ID NO: 3392389 - protein, 26 aa, Plasmodium falciparum
QTKNNHIILFILKKIQRILQYIPQSL

SEQ ID NO: 3392390 - protein, 22 aa, Plasmodium falciparum
QTKYMNIHLFYHKDDKEALNII

SEQ ID NO: 3392391 - protein, 18 aa, Plasmodium falciparum
QTLNQSFLSIFRIKKEKK

SEQ ID NO: 3392392 - protein, 18 aa, Plasmodium falciparum
QTLYFSPCNQKKALLIGI

SEQ ID NO: 3392393 - protein, 25 aa, Plasmodium falciparum
QTNGSIYMWNFKKYLSDLNKYKKKK

SEQ ID NO: 3392394 - protein, 27 aa, Plasmodium falciparum
QTSEIYMTKLLKKIKVDFLKTQEYLTK

SEQ ID NO: 3392395 - protein, 34 aa, Plasmodium falciparum
QTSIQNYYKSLYFIKFFLGIIPYKTTYIHHPSDH

SEQ ID NO: 3392396 - protein, 26 aa, Plasmodium falciparum
QTYLKKEVCLIPFKFFDIDGNGKISV

SEQ ID NO: 3392397 - protein, 17 aa, Plasmodium falciparum
QVDDYVSVIFNSFNFSN

SEQ ID NO: 3392398 - protein, 26 aa, Plasmodium falciparum
QVEKLELLFFIFYESLKRKREILYIK

SEQ ID NO: 3392399 - protein, 19 aa, Plasmodium falciparum
QVFYHKHIYEKNKGHLYNL

SEQ ID NO: 3392400 - protein, 23 aa, Plasmodium falciparum
QVHIIQKYMSIFLQNGFEVQILE

SEQ ID NO: 3392401 - protein, 20 aa, Plasmodium falciparum
QVHNFFLISKQIRNILRSNN

SEQ ID NO: 3392402 - protein, 25 aa, Plasmodium falciparum
QVKFKELFKIWKNASNKLITDFTRK

SEQ ID NO: 3392403 - protein, 24 aa, Plasmodium falciparum
QVLKHRWFKKFKSNNLIINKTLNK

SEQ ID NO: 3392404 - protein, 46 aa, Plasmodium falciparum
QVLNTFNIYTKIKKGFIFFYGSGHRNQWILPVHNKITKIIKLCSES

SEQ ID NO: 3392405 - protein, 23 aa, Plasmodium falciparum
QVLRNPLVNNELFCNYHKIQIKK

SEQ ID NO: 3392406 - protein, 17 aa, Plasmodium falciparum
QVMFFSATMAKEMRDVC

SEQ ID NO: 3392407 - protein, 25 aa, Plasmodium falciparum
QVNDFLLYNNNILEYKKEQKNYFIS

SEQ ID NO: 3392408 - protein, 22 aa, Plasmodium falciparum
QVPKRWLSRNPADIEYLVKLDR

SEQ ID NO: 3392409 - protein, 20 aa, Plasmodium falciparum
QVPLFHLNEMCIINNLIKMR

SEQ ID NO: 3392410 - protein, 17 aa, Plasmodium falciparum
QVRKHMQAFIKPGKKMI

SEQ ID NO: 3392411 - protein, 18 aa, Plasmodium falciparum
QVRWCFFDKLILSAHENG

SEQ ID NO: 3392412 - protein, 25 aa, Plasmodium falciparum
QVTDELWICNLKKRTWEHISCKEKE

SEQ ID NO: 3392413 - protein, 25 aa, Plasmodium falciparum
QVVIKFCPKYIKTYFYNIEFFIEEI

SEQ ID NO: 3392414 - protein, 20 aa, Plasmodium falciparum
QVYDFILRKNIPINESFKSS

SEQ ID NO: 3392415 - protein, 19 aa, Plasmodium falciparum
QWIPYQYRHDLFLIGDLYG

SEQ ID NO: 3392416 - protein, 23 aa, Plasmodium falciparum
QWNYLEHRGLIFSPPYVQHHVPI

SEQ ID NO: 3392417 - protein, 20 aa, Plasmodium falciparum
QYAHIIIEKYIQCTELLLKE

SEQ ID NO: 3392418 - protein, 20 aa, Plasmodium falciparum
QYARYLYYIGKILAVQLDYS

SEQ ID NO: 3392419 - protein, 30 aa, Plasmodium falciparum
QYCILIDMKQKFICLIYMLLDCIEKKKKPV

SEQ ID NO: 3392420 - protein, 24 aa, Plasmodium falciparum
QYDAQMSDFYNFHLNSMNSINDTN

SEQ ID NO: 3392421 - protein, 20 aa, Plasmodium falciparum
QYEDIVIFDLLWSDPQKKEG

SEQ ID NO: 3392422 - protein, 19 aa, Plasmodium falciparum
QYEELYICIDHCVAKDLFN

SEQ ID NO: 3392423 - protein, 17 aa, Plasmodium falciparum
QYFHIFTKVRQKFEITT

SEQ ID NO: 3392424 - protein, 18 aa, Plasmodium falciparum
QYFPDLFHNVYFLCAHYT

SEQ ID NO: 3392425 - protein, 19 aa, Plasmodium falciparum
QYHMYQNESIIPFLENEHS

SEQ ID NO: 3392426 - protein, 19 aa, Plasmodium falciparum
QYIALRNINLITQKLPNML

SEQ ID NO: 3392427 - protein, 21 aa, Plasmodium falciparum
QYIENVIISALQLYSLIEKQT

SEQ ID NO: 3392428 - protein, 37 aa, Plasmodium falciparum
QYIHNQSVPLRFYLIKNILPILTDALIYICKTKPKNP

SEQ ID NO: 3392429 - protein, 18 aa, Plasmodium falciparum
QYIPKDIPILFVHSIHDC

SEQ ID NO: 3392430 - protein, 17 aa, Plasmodium falciparum
QYKNILRGYTNKIVKIL

SEQ ID NO: 3392431 - protein, 18 aa, Plasmodium falciparum
QYLIKNLPYTHIKEKRSL

SEQ ID NO: 3392432 - protein, 23 aa, Plasmodium falciparum
QYLNQYIIRIISKIIEKYKINSS

SEQ ID NO: 3392433 - protein, 27 aa, Plasmodium falciparum
QYLNSFIFTYLFLNRYINYKDVYRYCN

SEQ ID NO: 3392434 - protein, 20 aa, Plasmodium falciparum
QYMMFLLYKEYLSSKNEKYG

SEQ ID NO: 3392435 - protein, 28 aa, Plasmodium falciparum
QYNDSYLNFIEKMLVPIYNHNIKVVFVF

SEQ ID NO: 3392436 - protein, 19 aa, Plasmodium falciparum
QYNFSPLQVFFLQEMERIK

SEQ ID NO: 3392437 - protein, 22 aa, Plasmodium falciparum
QYPERTIISPKNKLLQSVTLDW

SEQ ID NO: 3392438 - protein, 27 aa, Plasmodium falciparum
QYREYLGYNIIYIKKKVLLLGSGGLCI

SEQ ID NO: 3392439 - protein, 20 aa, Plasmodium falciparum
QYRHDLFLIGDLYGVKIISK

SEQ ID NO: 3392440 - protein, 17 aa, Plasmodium falciparum
QYYRRIRFMLQGIQKHI

SEQ ID NO: 3392441 - protein, 20 aa, Plasmodium falciparum
QYYSFDLIIWENKSARMNNN

SEQ ID NO: 3392442 - protein, 20 aa, Plasmodium falciparum
QYYYDLDYIKMILSFNEYFT

SEQ ID NO: 3392443 - protein, 25 aa, Plasmodium falciparum
RACEEIMNRLTSIKLSYDNVSKLKE

SEQ ID NO: 3392444 - protein, 28 aa, Plasmodium falciparum
RAEATHLMNCDFLFTSFKDGSPLRGLAQ

SEQ ID NO: 3392445 - protein, 17 aa, Plasmodium falciparum
RAEGMKFLGKLMQKWSK

SEQ ID NO: 3392446 - protein, 23 aa, Plasmodium falciparum
RAHQLVMEGYKWSFNKKLVTIWS

SEQ ID NO: 3392447 - protein, 20 aa, Plasmodium falciparum
RAIYSSVLLATPRLLEPILL

SEQ ID NO: 3392448 - protein, 21 aa, Plasmodium falciparum
RAKHFNILLDDVAITHLSYGK

SEQ ID NO: 3392449 - protein, 27 aa, Plasmodium falciparum
RAKKSLKSFMWMSLEYKSILMEDLARQ

SEQ ID NO: 3392450 - protein, 19 aa, Plasmodium falciparum
RALKLFKRGIKNILVATDV

SEQ ID NO: 3392451 - protein, 17 aa, Plasmodium falciparum
RALKTKSKTPKYGLIYH

SEQ ID NO: 3392452 - protein, 22 aa, Plasmodium falciparum
RAMRLWINPNYLKKLSESIKNL

SEQ ID NO: 3392453 - protein, 29 aa, Plasmodium falciparum
RANCKTIHKYFSVKKYGFEKARELAIKCR

SEQ ID NO: 3392454 - protein, 35 aa, Plasmodium falciparum
RANKYDDWLVHKLCKWLYNINDKLYFNIDKQEIYH

SEQ ID NO: 3392455 - protein, 18 aa, Plasmodium falciparum
RAPNNFSNPFHKSFSFVD

SEQ ID NO: 3392456 - protein, 21 aa, Plasmodium falciparum
RASAIITQLYEYPIIGKKESL

SEQ ID NO: 3392457 - protein, 26 aa, Plasmodium falciparum
RASDTYGLILLPTRELCLQVLDEIKS

SEQ ID NO: 3392458 - protein, 17 aa, Plasmodium falciparum
RASYVKAWWNLVNWNFA

SEQ ID NO: 3392459 - protein, 19 aa, Plasmodium falciparum
RAWDFLDTVEFLIDIESEF

SEQ ID NO: 3392460 - protein, 17 aa, Plasmodium falciparum
RAYKELLISLRGDKYYM

SEQ ID NO: 3392461 - protein, 18 aa, Plasmodium falciparum
RAYMLIKGYNKKVDINLS

SEQ ID NO: 3392462 - protein, 35 aa, Plasmodium falciparum
RAYNVLTYMQEKVSVIIFTIKFIGQKLKRKHVPEE

SEQ ID NO: 3392463 - protein, 26 aa, Plasmodium falciparum
RAYQASTQLLIPKIPFVRVVKEITRL

SEQ ID NO: 3392464 - protein, 38 aa, Plasmodium falciparum
RCCDSDRFVALNKLFPPPLKPFTVVPKPQPVLQWEEEL

SEQ ID NO: 3392465 - protein, 17 aa, Plasmodium falciparum
RCDSWSLGIILADLAKC

SEQ ID NO: 3392466 - protein, 35 aa, Plasmodium falciparum
RCEAHTNCFLLAIDKISFIKNFSILFNDLLQEADI

SEQ ID NO: 3392467 - protein, 22 aa, Plasmodium falciparum
RCEIYICVLGDLLMTHPNLNND

SEQ ID NO: 3392468 - protein, 18 aa, Plasmodium falciparum
RCESSFYRSFTLPENVSE

SEQ ID NO: 3392469 - protein, 18 aa, Plasmodium falciparum
RCFIKDIELINAQFILNI

SEQ ID NO: 3392470 - protein, 21 aa, Plasmodium falciparum
RCIESLFKAISNLSLYTVNVK

SEQ ID NO: 3392471 - protein, 20 aa, Plasmodium falciparum
RCIRNILYCSNKLMINNRAY

SEQ ID NO: 3392472 - protein, 17 aa, Plasmodium falciparum
RCISLFSSIRYYYYCDN

SEQ ID NO: 3392473 - protein, 21 aa, Plasmodium falciparum
RCKPMFHVHGSRKAVDAAITN

SEQ ID NO: 3392474 - protein, 30 aa, Plasmodium falciparum
RCLKQEINIPLYYNLPSLFRNFKICSFSRK

SEQ ID NO: 3392475 - protein, 29 aa, Plasmodium falciparum
RCQQYDNFILKWKTLFDIQSKKYKELYEP

SEQ ID NO: 3392476 - protein, 37 aa, Plasmodium falciparum
RCQYSHNEFWNRRCPFYLSDSSFIRYITVMCPDVETR

SEQ ID NO: 3392477 - protein, 28 aa, Plasmodium falciparum
RCRIEVKIIILYIIKQKYKTALSLIDRL

SEQ ID NO: 3392478 - protein, 26 aa, Plasmodium falciparum
RCRTLKVHIYLLTHLRKKLPFFKKFL

SEQ ID NO: 3392479 - protein, 17 aa, Plasmodium falciparum
RCSGVINSIIWSNNDTL

SEQ ID NO: 3392480 - protein, 27 aa, Plasmodium falciparum
RCTTYRRSVRLLLLNKEKNTNLTNNIV

SEQ ID NO: 3392481 - protein, 23 aa, Plasmodium falciparum
RCVLLIYFIKWNGYNFHMLKRQF

SEQ ID NO: 3392482 - protein, 20 aa, Plasmodium falciparum
RCWVLLASKSPRRIELMKLM

SEQ ID NO: 3392483 - protein, 17 aa, Plasmodium falciparum
RCYETISIPFLVNYVRK

SEQ ID NO: 3392484 - protein, 26 aa, Plasmodium falciparum
RCYLKKRNFYNVCLIKRGIKNSKLNE

SEQ ID NO: 3392485 - protein, 33 aa, Plasmodium falciparum
RDAEKYIKFLSNVKIYFLKKLDDIDYFNTNCKD

SEQ ID NO: 3392486 - protein, 19 aa, Plasmodium falciparum
RDANYFNFIPSCERVAKMN

SEQ ID NO: 3392487 - protein, 19 aa, Plasmodium falciparum
RDDIYYYHNQLKKLERLTQ

SEQ ID NO: 3392488 - protein, 40 aa, Plasmodium falciparum
RDDLHFDGHPQSSILKILWFGYVDICKCILKNRDGYLYKG

SEQ ID NO: 3392489 - protein, 29 aa, Plasmodium falciparum
RDDQIYNYFLRYPVVRTILTQYRKQVLKG

SEQ ID NO: 3392490 - protein, 21 aa, Plasmodium falciparum
RDEFTLLLKIKPKTVRQKRIE

SEQ ID NO: 3392491 - protein, 23 aa, Plasmodium falciparum
RDEKKLLLLQLNAILFDQRINEI

SEQ ID NO: 3392492 - protein, 31 aa, Plasmodium falciparum
RDEKKVRYFFNYVKDYLTKHLDYIVFNGCQI

SEQ ID NO: 3392493 - protein, 25 aa, Plasmodium falciparum
RDEYSNRTIIKALINKITNTPMINN

SEQ ID NO: 3392494 - protein, 21 aa, Plasmodium falciparum
RDHSYLYKPFGLPSYVIKMLN

SEQ ID NO: 3392495 - protein, 20 aa, Plasmodium falciparum
RDIHFWLVCISLIDYIDLIT

SEQ ID NO: 3392496 - protein, 25 aa, Plasmodium falciparum
RDIKPQNILIFLNKTNKMKTNKTYI

SEQ ID NO: 3392497 - protein, 26 aa, Plasmodium falciparum
RDKDLQFYYINSRPIHILKNVNKLIN

SEQ ID NO: 3392498 - protein, 20 aa, Plasmodium falciparum
RDKFPFDRINRTRHTFFNRG

SEQ ID NO: 3392499 - protein, 23 aa, Plasmodium falciparum
RDKKFILWRVSDGTQIGLYECSG

SEQ ID NO: 3392500 - protein, 23 aa, Plasmodium falciparum
RDKKLKKGGKFWEGGKGCRNAIT

SEQ ID NO: 3392501 - protein, 18 aa, Plasmodium falciparum
RDKPQLPPYCRYSSTMKS

SEQ ID NO: 3392502 - protein, 20 aa, Plasmodium falciparum
RDKYGVFPLKGKLLNVRDAS

SEQ ID NO: 3392503 - protein, 24 aa, Plasmodium falciparum
RDLKPENIFLCKIQISQKEKTLIR

SEQ ID NO: 3392504 - protein, 17 aa, Plasmodium falciparum
RDLTKEGTLIYKSEKEY

SEQ ID NO: 3392505 - protein, 18 aa, Plasmodium falciparum
RDLYKNDLINILNEKEEQ

SEQ ID NO: 3392506 - protein, 18 aa, Plasmodium falciparum
RDMALRYVKDPRTIILAV

SEQ ID NO: 3392507 - protein, 25 aa, Plasmodium falciparum
RDNNFYNITLRKFHFIQTISNNNFN

SEQ ID NO: 3392508 - protein, 23 aa, Plasmodium falciparum
RDSIPFGSYVFYFAGKSVQVDNM

SEQ ID NO: 3392509 - protein, 18 aa, Plasmodium falciparum
RDSQIYDHNICGLIKEHQ

SEQ ID NO: 3392510 - protein, 18 aa, Plasmodium falciparum
RDTFCLLCSYFSDASLYI

SEQ ID NO: 3392511 - protein, 24 aa, Plasmodium falciparum
RDVKWNVVIKNMLENFLYNVDMND

SEQ ID NO: 3392512 - protein, 29 aa, Plasmodium falciparum
RDYQHAGLHWLLYLYKNNINGILADEMGL

SEQ ID NO: 3392513 - protein, 32 aa, Plasmodium falciparum
RDYTNNYIKERKKYIFLYNNNENNYKEILNEY

SEQ ID NO: 3392514 - protein, 25 aa, Plasmodium falciparum
REACTVLCDWSYDGTLFMTASTYPR

SEQ ID NO: 3392515 - protein, 25 aa, Plasmodium falciparum
REDEDPLYIVDIFCKIHALKNENKQ

SEQ ID NO: 3392516 - protein, 24 aa, Plasmodium falciparum
REDLLIRDLHWIIGPKLYEANWVE

SEQ ID NO: 3392517 - protein, 22 aa, Plasmodium falciparum
REEQMNFVNRLNMLMNEADINK

SEQ ID NO: 3392518 - protein, 31 aa, Plasmodium falciparum
REERENLGLLKRNGWRDLICSTFLEDVHENI

SEQ ID NO: 3392519 - protein, 23 aa, Plasmodium falciparum
REERNLIRMKYKCTPQSIMIPIL

SEQ ID NO: 3392520 - protein, 22 aa, Plasmodium falciparum
REFKNFYILKFSFNKTIDEYNN

SEQ ID NO: 3392521 - protein, 18 aa, Plasmodium falciparum
REFLHLPPSIFPATLSKK

SEQ ID NO: 3392522 - protein, 18 aa, Plasmodium falciparum
REGIQRIFNLFDDDKTGS

SEQ ID NO: 3392523 - protein, 26 aa, Plasmodium falciparum
REGKFFSLYDIVLFTIKKITYGDNGA

SEQ ID NO: 3392524 - protein, 29 aa, Plasmodium falciparum
REHDYTDFLIIKINSLKGPGGKPYMRLEL

SEQ ID NO: 3392525 - protein, 33 aa, Plasmodium falciparum
REIAAVHDVFFLIKGVFAFYTYYNQVLSTCVHD

SEQ ID NO: 3392526 - protein, 19 aa, Plasmodium falciparum
REIADFQLVINKYLNNKKK

SEQ ID NO: 3392527 - protein, 18 aa, Plasmodium falciparum
REIHRFTPHLTCIKICGS

SEQ ID NO: 3392528 - protein, 30 aa, Plasmodium falciparum
REIQNECHIILLPYNYLFEESTRKILKLNL

SEQ ID NO: 3392529 - protein, 20 aa, Plasmodium falciparum
REIVSLSRRLPGIKSSLLSL

SEQ ID NO: 3392530 - protein, 25 aa, Plasmodium falciparum
REIYENFFTNLYTYPVDLLCIYNNC

SEQ ID NO: 3392531 - protein, 38 aa, Plasmodium falciparum
REKEKQFGFISPSHPYFYYYQYKLHGLFLDIQEKDELI

SEQ ID NO: 3392532 - protein, 17 aa, Plasmodium falciparum
REKFSMFVQSICSIPLP

SEQ ID NO: 3392533 - protein, 26 aa, Plasmodium falciparum
REKKKLLIKQLKKIKFSKLYKDISLR

SEQ ID NO: 3392534 - protein, 31 aa, Plasmodium falciparum
REKKYIIKKDILIKIFLRRASSFLCLQEFNK

SEQ ID NO: 3392535 - protein, 17 aa, Plasmodium falciparum
REKLTNWLFVCMCSRCT

SEQ ID NO: 3392536 - protein, 26 aa, Plasmodium falciparum
REKNDNFLIVQKYIKNLCNISSETVN

SEQ ID NO: 3392537 - protein, 25 aa, Plasmodium falciparum
RELAVQIFYDAKKFCFETGIKPVVL

SEQ ID NO: 3392538 - protein, 28 aa, Plasmodium falciparum
RENDQFKKIIYKYKIDYYEYYVGSTNIN

SEQ ID NO: 3392539 - protein, 25 aa, Plasmodium falciparum
RENLKAWDLFVKLTSSNPIERLSLQ

SEQ ID NO: 3392540 - protein, 18 aa, Plasmodium falciparum
RENRMNNLILNYNNKNNL

SEQ ID NO: 3392541 - protein, 26 aa, Plasmodium falciparum
REPKRSERLYLRRKRASSILSNNSTE

SEQ ID NO: 3392542 - protein, 25 aa, Plasmodium falciparum
REPSKILWRCVRGMLPHKTYKGQLA

SEQ ID NO: 3392543 - protein, 29 aa, Plasmodium falciparum
REQICYSTKLLNKSPYRKLSENKIDLINY

SEQ ID NO: 3392544 - protein, 26 aa, Plasmodium falciparum
REQIMNYFIIFTYINQLEISEIYSLV

SEQ ID NO: 3392545 - protein, 19 aa, Plasmodium falciparum
REQTISNLLKDTFNLKDED

SEQ ID NO: 3392546 - protein, 24 aa, Plasmodium falciparum
RESDTFFLSLFMYSKYVDKIYRKS

SEQ ID NO: 3392547 - protein, 23 aa, Plasmodium falciparum
RESLATYLKYRMNSIAPNLTYLV

SEQ ID NO: 3392548 - protein, 24 aa, Plasmodium falciparum
RETDYLPINNTYNTLPISINNKTN

SEQ ID NO: 3392549 - protein, 22 aa, Plasmodium falciparum
REVGYFKRIFKLPNNILDDTAK

SEQ ID NO: 3392550 - protein, 20 aa, Plasmodium falciparum
REYIYTILKNRLLGSHICID

SEQ ID NO: 3392551 - protein, 21 aa, Plasmodium falciparum
REYRCRILGLVSIKLNPFFYK

SEQ ID NO: 3392552 - protein, 17 aa, Plasmodium falciparum
RFAILKKNLKFFKIHNL

SEQ ID NO: 3392553 - protein, 19 aa, Plasmodium falciparum
RFCLLCNYVNKITPAIQSR

SEQ ID NO: 3392554 - protein, 20 aa, Plasmodium falciparum
RFENGFIFDPYTFSPEHTVA

SEQ ID NO: 3392555 - protein, 36 aa, Plasmodium falciparum
RFEQYGDIMHMQWKKRFAFIEYYKASHALNALEKEN

SEQ ID NO: 3392556 - protein, 18 aa, Plasmodium falciparum
RFFESSLLLEKWANEQNN

SEQ ID NO: 3392557 - protein, 23 aa, Plasmodium falciparum
RFGKYLIDTWYFSPYPKEYQNID

SEQ ID NO: 3392558 - protein, 18 aa, Plasmodium falciparum
RFGPTAIPLPLLERDNIK

SEQ ID NO: 3392559 - protein, 21 aa, Plasmodium falciparum
RFIYTLGTFDGSVYFYDSEIL

SEQ ID NO: 3392560 - protein, 26 aa, Plasmodium falciparum
RFLNVDLFNFIKKYNKLFLNTFSLSM

SEQ ID NO: 3392561 - protein, 40 aa, Plasmodium falciparum
RFNKINDFYYLIYFMTKQLYLRLKIKNLKAKLLHVNFFIK

SEQ ID NO: 3392562 - protein, 22 aa, Plasmodium falciparum
RFPTLCMISFCLSYLGLTNQSV

SEQ ID NO: 3392563 - protein, 18 aa, Plasmodium falciparum
RFRTITSSYYRGAQGIII

SEQ ID NO: 3392564 - protein, 30 aa, Plasmodium falciparum
RFSSTFWKVVYIQLLLSWKSRFHFFIDFIK

SEQ ID NO: 3392565 - protein, 21 aa, Plasmodium falciparum
RFTDEFLKHTSFLTLHTYGCR

SEQ ID NO: 3392566 - protein, 18 aa, Plasmodium falciparum
RGDYKPHVIFLLEGNEIK

SEQ ID NO: 3392567 - protein, 31 aa, Plasmodium falciparum
RGETYPGSFQFIFELAMNKLAAEAKPLLLSV

SEQ ID NO: 3392568 - protein, 19 aa, Plasmodium falciparum
RGFCLLHDLKTDILNLNIY

SEQ ID NO: 3392569 - protein, 25 aa, Plasmodium falciparum
RGFLKNWNINYLSTNFNNLIKHNEN

SEQ ID NO: 3392570 - protein, 22 aa, Plasmodium falciparum
RGGGNKGFFGKKFSSNSNNYNN

SEQ ID NO: 3392571 - protein, 18 aa, Plasmodium falciparum
RGIYKSYNFFKSMNMMNS

SEQ ID NO: 3392572 - protein, 27 aa, Plasmodium falciparum
RGKEKYGYLYLIKYLSNVDEYFYIKEK

SEQ ID NO: 3392573 - protein, 17 aa, Plasmodium falciparum
RGKLFKFTPQKKKVDVR

SEQ ID NO: 3392574 - protein, 21 aa, Plasmodium falciparum
RGKNIFSLKYAESFNFNSIHK

SEQ ID NO: 3392575 - protein, 18 aa, Plasmodium falciparum
RGKNKKVFLFDTTVMQKL

SEQ ID NO: 3392576 - protein, 19 aa, Plasmodium falciparum
RGLMNYMNHLNDLTCNNLM

SEQ ID NO: 3392577 - protein, 24 aa, Plasmodium falciparum
RGLNDSLVQYIFSIGLKGIKRNNE

SEQ ID NO: 3392578 - protein, 35 aa, Plasmodium falciparum
RGMECLFAHSQGELNPIPDLSFTSLCPLTKKSGLC

SEQ ID NO: 3392579 - protein, 19 aa, Plasmodium falciparum
RGMINKKNYVPIIFESVEN

SEQ ID NO: 3392580 - protein, 24 aa, Plasmodium falciparum
RGMVKTWSPLLIGKQIDGVWHTAV

SEQ ID NO: 3392581 - protein, 23 aa, Plasmodium falciparum
RGNKKIIYILSIKNQIVFYEEVG

SEQ ID NO: 3392582 - protein, 37 aa, Plasmodium falciparum
RGNRVLIFSQMVKMLNILSEYLTLRGFKHQRLDGTMT

SEQ ID NO: 3392583 - protein, 36 aa, Plasmodium falciparum
RGNYSLEVICLLFSLKILFPKHIYLLRGNHEDRLFN

SEQ ID NO: 3392584 - protein, 31 aa, Plasmodium falciparum
RGSRMKILEPNTPFNFILMDSASEDEASKYG

SEQ ID NO: 3392585 - protein, 24 aa, Plasmodium falciparum
RGSSFLPFNYCCISLRPFSEPYCD

SEQ ID NO: 3392586 - protein, 35 aa, Plasmodium falciparum
RGVIWEETIILLPLMVRFIFLSATIPNGIQFAEWV

SEQ ID NO: 3392587 - protein, 18 aa, Plasmodium falciparum
RGYQKVPNYLKESNNLHM

SEQ ID NO: 3392588 - protein, 24 aa, Plasmodium falciparum
RGYWKKMHYFIRKNNMMSYAFKVQ

SEQ ID NO: 3392589 - protein, 26 aa, Plasmodium falciparum
RGYYGSLCFLPYKKSLFVFGGTDNSE

SEQ ID NO: 3392590 - protein, 19 aa, Plasmodium falciparum
RHDDQLFISLTTNKNKPQK

SEQ ID NO: 3392591 - protein, 23 aa, Plasmodium falciparum
RHDKSFYELLDKITWEYNELYVY

SEQ ID NO: 3392592 - protein, 25 aa, Plasmodium falciparum
RHDYSPYIFSIKDALLYKCKQINEQ

SEQ ID NO: 3392593 - protein, 29 aa, Plasmodium falciparum
RHETILEGWLHLKKPFILCGPPGSGKTMT

SEQ ID NO: 3392594 - protein, 18 aa, Plasmodium falciparum
RHFFIPYTILKDVVKRNI

SEQ ID NO: 3392595 - protein, 29 aa, Plasmodium falciparum
RHGMDLPLTYIIVPYYYNFNHIDYDAVLL

SEQ ID NO: 3392596 - protein, 26 aa, Plasmodium falciparum
RHHQKLLMSYTPFNSPSLLAEQINIL

SEQ ID NO: 3392597 - protein, 29 aa, Plasmodium falciparum
RHIETYKTVFLCYPCVYRSIEDFTKSHKK

SEQ ID NO: 3392598 - protein, 24 aa, Plasmodium falciparum
RHKFNTLKLNYNEKLLLTGGFGNL

SEQ ID NO: 3392599 - protein, 17 aa, Plasmodium falciparum
RHKIVLSKKKRKLFARI

SEQ ID NO: 3392600 - protein, 26 aa, Plasmodium falciparum
RHKKNVFFPYAIILTNTREAACELFS

SEQ ID NO: 3392601 - protein, 25 aa, Plasmodium falciparum
RHNKNRIFYFPQRNTDNILRPPYNN

SEQ ID NO: 3392602 - protein, 24 aa, Plasmodium falciparum
RHNNHFKRLFKAKQMLLNEVDRIK

SEQ ID NO: 3392603 - protein, 18 aa, Plasmodium falciparum
RHNNIPHNNFRHNNIPHN

SEQ ID NO: 3392604 - protein, 23 aa, Plasmodium falciparum
RHSINNVFNFLKTKGYNVDYLHG

SEQ ID NO: 3392605 - protein, 17 aa, Plasmodium falciparum
RHVHKTFLPCLKEDPFT

SEQ ID NO: 3392606 - protein, 33 aa, Plasmodium falciparum
RHWKLILQKLNIKIYYNKLTLGNLWSLHLCIHE

SEQ ID NO: 3392607 - protein, 45 aa, Plasmodium falciparum
RICYVPFYNNYYKNKNIWYRLNMKIFLYCWWYVEEVCFSDCTMNT

SEQ ID NO: 3392608 - protein, 19 aa, Plasmodium falciparum
RIDDTSIPSIYVKKSNKRI

SEQ ID NO: 3392609 - protein, 24 aa, Plasmodium falciparum
RIDMLYQYIINEIKFLKKKKINFL

SEQ ID NO: 3392610 - protein, 18 aa, Plasmodium falciparum
RIDYPRRSSYREDISIKY

SEQ ID NO: 3392611 - protein, 22 aa, Plasmodium falciparum
RIENIILPYKYNNDILRIEIKT

SEQ ID NO: 3392612 - protein, 17 aa, Plasmodium falciparum
RIESILKESYRDRLQKF

SEQ ID NO: 3392613 - protein, 21 aa, Plasmodium falciparum
RIFEPMLRLNLTCESTVLGKV

SEQ ID NO: 3392614 - protein, 26 aa, Plasmodium falciparum
RIGLVGIKCRCNHYFCSLHRYADAHN

SEQ ID NO: 3392615 - protein, 30 aa, Plasmodium falciparum
RIGRPKTFPIEYHSLIPQATIPAIDNYYLS

SEQ ID NO: 3392616 - protein, 23 aa, Plasmodium falciparum
RIHKTRHVIQIQDILFSFAIIMH

SEQ ID NO: 3392617 - protein, 26 aa, Plasmodium falciparum
RIHYIFNDWYIKSLNDFSPLEMLTDE

SEQ ID NO: 3392618 - protein, 31 aa, Plasmodium falciparum
RIIIHDFISGKLLYNFLPDYFKKTSHIYCKN

SEQ ID NO: 3392619 - protein, 28 aa, Plasmodium falciparum
RIIILNKVDLIPRRLALKAQSLIEEKTN

SEQ ID NO: 3392620 - protein, 29 aa, Plasmodium falciparum
RIILVLEGGYNLNYLPKCALACIKALIKK

SEQ ID NO: 3392621 - protein, 18 aa, Plasmodium falciparum
RIIYKKKHPMFFNNIHTM

SEQ ID NO: 3392622 - protein, 20 aa, Plasmodium falciparum
RIKCIIKALKEKKLINKMVQ

SEQ ID NO: 3392623 - protein, 28 aa, Plasmodium falciparum
RIKCSTSLIYMLSLKCRYIESIWLNVAK

SEQ ID NO: 3392624 - protein, 25 aa, Plasmodium falciparum
RIKDERMKYIYKSYRSCPLKETEKT

SEQ ID NO: 3392625 - protein, 30 aa, Plasmodium falciparum
RIKINMCENPCDIWYGLKKRNGKNIFINSS

SEQ ID NO: 3392626 - protein, 18 aa, Plasmodium falciparum
RILINYILRKNKKKCFTV

SEQ ID NO: 3392627 - protein, 19 aa, Plasmodium falciparum
RILKPIQSFGYRGEGLSGM

SEQ ID NO: 3392628 - protein, 19 aa, Plasmodium falciparum
RILLNCNKYIEDNNMYKIE

SEQ ID NO: 3392629 - protein, 18 aa, Plasmodium falciparum
RILYFNKIITKGLCSKGF

SEQ ID NO: 3392630 - protein, 29 aa, Plasmodium falciparum
RIMQESILIAYTYSMKLLNTIMLKFESKP

SEQ ID NO: 3392631 - protein, 17 aa, Plasmodium falciparum
RIMYKIHPKTKNKWVIY

SEQ ID NO: 3392632 - protein, 24 aa, Plasmodium falciparum
RINDNWSLIYAYEKAKKKKAHLFA

SEQ ID NO: 3392633 - protein, 18 aa, Plasmodium falciparum
RINIIMRRKKKRKRKKKR

SEQ ID NO: 3392634 - protein, 18 aa, Plasmodium falciparum
RINKRNIIYLNATRYYCN

SEQ ID NO: 3392635 - protein, 17 aa, Plasmodium falciparum
RINKVARKNLRVCLGDV

SEQ ID NO: 3392636 - protein, 25 aa, Plasmodium falciparum
RINLGSIVLLLKALGINDFLHFDFM

SEQ ID NO: 3392637 - protein, 19 aa, Plasmodium falciparum
RINNFLQYRIPHMNNNGNI

SEQ ID NO: 3392638 - protein, 19 aa, Plasmodium falciparum
RIPIFGKNFLDLIKKEFTK

SEQ ID NO: 3392639 - protein, 34 aa, Plasmodium falciparum
RIPLLIYESYHFWHLQFLFEKFKIKRQKLILNPF

SEQ ID NO: 3392640 - protein, 39 aa, Plasmodium falciparum
RIPQSLMRISLTFMFEPPVGIKFSILRSFSLFLENRELC

SEQ ID NO: 3392641 - protein, 18 aa, Plasmodium falciparum
RIQQTEGIFKELLDSFQK

SEQ ID NO: 3392642 - protein, 20 aa, Plasmodium falciparum
RIRAILLDLKRRSLIRNMTK

SEQ ID NO: 3392643 - protein, 17 aa, Plasmodium falciparum
RIRFMLQGIQKHISQYN

SEQ ID NO: 3392644 - protein, 18 aa, Plasmodium falciparum
RIRIDIFQLFKYNHTYYS

SEQ ID NO: 3392645 - protein, 20 aa, Plasmodium falciparum
RIRKVSPYGKLKTWDLKCVI

SEQ ID NO: 3392646 - protein, 25 aa, Plasmodium falciparum
RIRTYNRFVCFLIGGTFAYSFSNPD

SEQ ID NO: 3392647 - protein, 18 aa, Plasmodium falciparum
RISLCELLCSLPDILDKN

SEQ ID NO: 3392648 - protein, 27 aa, Plasmodium falciparum
RISTTQMPLYYFRDTHSISLLYSFCTL

SEQ ID NO: 3392649 - protein, 18 aa, Plasmodium falciparum
RITKRLYAPPTFNEVRHI

SEQ ID NO: 3392650 - protein, 20 aa, Plasmodium falciparum
RITLGKVYFELFNDEEIKKS

SEQ ID NO: 3392651 - protein, 28 aa, Plasmodium falciparum
RITMTVLGMIYLLIKDVALIEHKKISQL

SEQ ID NO: 3392652 - protein, 27 aa, Plasmodium falciparum
RIVAMNAHMFLKTGGWFIISIKANCVD

SEQ ID NO: 3392653 - protein, 18 aa, Plasmodium falciparum
RIVRNNLMKLIKVLKEFP

SEQ ID NO: 3392654 - protein, 19 aa, Plasmodium falciparum
RIYHIIVKKNFIRKDENKE

SEQ ID NO: 3392655 - protein, 19 aa, Plasmodium falciparum
RIYHKIFNPPKVPFRDDVT

SEQ ID NO: 3392656 - protein, 22 aa, Plasmodium falciparum
RIYNKLKLHKIIRKKQYTDIPS

SEQ ID NO: 3392657 - protein, 21 aa, Plasmodium falciparum
RIYQTINKNVFPIYNFNRYEN

SEQ ID NO: 3392658 - protein, 17 aa, Plasmodium falciparum
RIYVGNLPSHVSSRDVE

SEQ ID NO: 3392659 - protein, 20 aa, Plasmodium falciparum
RKAYSVIRRGVKEAYKLSIE

SEQ ID NO: 3392660 - protein, 21 aa, Plasmodium falciparum
RKCPFNTFFVGELNLDNLLNM

SEQ ID NO: 3392661 - protein, 17 aa, Plasmodium falciparum
RKDCTYSTFDENFFKSH

SEQ ID NO: 3392662 - protein, 24 aa, Plasmodium falciparum
RKDFSQYPIYPWVISSYTTNEKLE

SEQ ID NO: 3392663 - protein, 29 aa, Plasmodium falciparum
RKDTNYYSYFVYILKKYKNFKNLQNLFLQ

SEQ ID NO: 3392664 - protein, 28 aa, Plasmodium falciparum
RKEAEKNLYSLLYSKNYDDLLSNHDYVI

SEQ ID NO: 3392665 - protein, 33 aa, Plasmodium falciparum
RKEALETLGKCLSMFILYITDGAMEYCENEKRS

SEQ ID NO: 3392666 - protein, 40 aa, Plasmodium falciparum
RKECNLFERNFRILQKKRSYKFLHCFNYIKNIIDNVYNNL

SEQ ID NO: 3392667 - protein, 24 aa, Plasmodium falciparum
RKEFQEYRRSPKNKLYGLIMNIIK

SEQ ID NO: 3392668 - protein, 19 aa, Plasmodium falciparum
RKEHILNYLSSFEKAKENK

SEQ ID NO: 3392669 - protein, 33 aa, Plasmodium falciparum
RKEHTLYICSYLKQFQLLTKSKMNILKHSDILH

SEQ ID NO: 3392670 - protein, 26 aa, Plasmodium falciparum
RKEKRIRLIYLKKILKKKLKIKKCMK

SEQ ID NO: 3392671 - protein, 18 aa, Plasmodium falciparum
RKELLDQKIYLGSSLTEQ

SEQ ID NO: 3392672 - protein, 23 aa, Plasmodium falciparum
RKENFIFLHNYMKKKENGNKTNI

SEQ ID NO: 3392673 - protein, 26 aa, Plasmodium falciparum
RKENFYNVYILTYIKHIVRIKSNLAL

SEQ ID NO: 3392674 - protein, 22 aa, Plasmodium falciparum
RKEYFLAYRICEYAGIKTDNIL

SEQ ID NO: 3392675 - protein, 25 aa, Plasmodium falciparum
RKFCSFRFYEYLFPVYVLSEVQVNE

SEQ ID NO: 3392676 - protein, 22 aa, Plasmodium falciparum
RKFDPYFIEGKILRIYDKDTIL

SEQ ID NO: 3392677 - protein, 19 aa, Plasmodium falciparum
RKFQLVQKFKETCVYLINI

SEQ ID NO: 3392678 - protein, 25 aa, Plasmodium falciparum
RKFYNLKCIILFNYIIENKIVFPDY

SEQ ID NO: 3392679 - protein, 22 aa, Plasmodium falciparum
RKGQELFHVFLSNGKKIQTTYS

SEQ ID NO: 3392680 - protein, 27 aa, Plasmodium falciparum
RKGRKRKIWIQPLDNYNKVEDNKLKEY

SEQ ID NO: 3392681 - protein, 20 aa, Plasmodium falciparum
RKGYNFYSGWPPVNRIKVTD

SEQ ID NO: 3392682 - protein, 27 aa, Plasmodium falciparum
RKHDDPLQFFILKEGKINIFYHTSKTK

SEQ ID NO: 3392683 - protein, 26 aa, Plasmodium falciparum
RKHDLAHIWCFLDDSVKVQHIKNYFS

SEQ ID NO: 3392684 - protein, 21 aa, Plasmodium falciparum
RKHLFPITNFLKNSGIMNPVD

SEQ ID NO: 3392685 - protein, 20 aa, Plasmodium falciparum
RKHMQAFIKPGKKMIDIAQE

SEQ ID NO: 3392686 - protein, 17 aa, Plasmodium falciparum
RKIFLDKFNKHDKEVLI

SEQ ID NO: 3392687 - protein, 19 aa, Plasmodium falciparum
RKIFQFFEINILQNVKNNI

SEQ ID NO: 3392688 - protein, 21 aa, Plasmodium falciparum
RKIFYYRAHYIKQHTTWNVLM

SEQ ID NO: 3392689 - protein, 17 aa, Plasmodium falciparum
RKIIFVFYNNYNKISNT

SEQ ID NO: 3392690 - protein, 17 aa, Plasmodium falciparum
RKIIMHPDFVEKYLQNK

SEQ ID NO: 3392691 - protein, 24 aa, Plasmodium falciparum
RKILRSIVHNVDPPAPLPLDEGKS

SEQ ID NO: 3392692 - protein, 39 aa, Plasmodium falciparum
RKINEELKQIIFYKEIKISYFINILNIIDEAILNDNNVK

SEQ ID NO: 3392693 - protein, 20 aa, Plasmodium falciparum
RKINLRNAWIIRLKKKNSII

SEQ ID NO: 3392694 - protein, 18 aa, Plasmodium falciparum
RKINYEKCFYYKNYIDIK

SEQ ID NO: 3392695 - protein, 19 aa, Plasmodium falciparum
RKIRWFKMNNMLNPVKEAK

SEQ ID NO: 3392696 - protein, 18 aa, Plasmodium falciparum
RKKEKIIITLKNENMYLK

SEQ ID NO: 3392697 - protein, 26 aa, Plasmodium falciparum
RKKKKNWPFCYFKKDTIKENDEMYNG

SEQ ID NO: 3392698 - protein, 23 aa, Plasmodium falciparum
RKKKPVFAFIAGKCAPPGKRMGH

SEQ ID NO: 3392699 - protein, 18 aa, Plasmodium falciparum
RKKKRINIIMRRKKKRKR

SEQ ID NO: 3392700 - protein, 25 aa, Plasmodium falciparum
RKKKSDILLQPIKTYDYLDNKWDTN

SEQ ID NO: 3392701 - protein, 24 aa, Plasmodium falciparum
RKKKTFCFYCLFEQFACNIISKKS

SEQ ID NO: 3392702 - protein, 30 aa, Plasmodium falciparum
RKKLCVFGRYKPLHWGVKEMSKFLKYYFES

SEQ ID NO: 3392703 - protein, 20 aa, Plasmodium falciparum
RKKNNLFMDKIKKKKLKSKN

SEQ ID NO: 3392704 - protein, 17 aa, Plasmodium falciparum
RKKRKEEILKEYLKITV

SEQ ID NO: 3392705 - protein, 28 aa, Plasmodium falciparum
RKKRQNQLQKLLLIMKQENNKNYNINYL

SEQ ID NO: 3392706 - protein, 19 aa, Plasmodium falciparum
RKKSKFSIEKKIDLFHMNS

SEQ ID NO: 3392707 - protein, 24 aa, Plasmodium falciparum
RKKSYIENYLNFIKVNIKSPCVYL

SEQ ID NO: 3392708 - protein, 26 aa, Plasmodium falciparum
RKLKEDLMKWKFTYNENENLLKKKQE

SEQ ID NO: 3392709 - protein, 21 aa, Plasmodium falciparum
RKLLYFKWKARKSYKKRVLNL

SEQ ID NO: 3392710 - protein, 21 aa, Plasmodium falciparum
RKLTNEIAMFKNRIKELEENL

SEQ ID NO: 3392711 - protein, 20 aa, Plasmodium falciparum
RKLVRPIKKLTEAYYILFSF

SEQ ID NO: 3392712 - protein, 24 aa, Plasmodium falciparum
RKMELDNMLHFYKEKLLDIKNHWD

SEQ ID NO: 3392713 - protein, 25 aa, Plasmodium falciparum
RKNFKEHINYFFNDCFKNFKNLNDK

SEQ ID NO: 3392714 - protein, 23 aa, Plasmodium falciparum
RKNKKFLYEKGKKKNFKNMNTNN

SEQ ID NO: 3392715 - protein, 25 aa, Plasmodium falciparum
RKNKLYQYEYYIPKLITYEEDISTE

SEQ ID NO: 3392716 - protein, 23 aa, Plasmodium falciparum
RKNKNFHYILQTLQKTKNKKNKT

SEQ ID NO: 3392717 - protein, 21 aa, Plasmodium falciparum
RKNLELLNRELKLNKISLGHQ

SEQ ID NO: 3392718 - protein, 17 aa, Plasmodium falciparum
RKNLLSLRILYEHNSIL

SEQ ID NO: 3392719 - protein, 26 aa, Plasmodium falciparum
RKNMADIYYFTKELQIVKKDKFKIIE

SEQ ID NO: 3392720 - protein, 44 aa, Plasmodium falciparum
RKNNYKFEFLGFVKYFYYFNNMSDFYYIPSFYNRYDYNTNYIHL

SEQ ID NO: 3392721 - protein, 25 aa, Plasmodium falciparum
RKNPKFERYIRPSSLRFKKANVYHS

SEQ ID NO: 3392722 - protein, 34 aa, Plasmodium falciparum
RKNQKYFRQYNILRFTYFKLLKQVGEMKVYNNNI

SEQ ID NO: 3392723 - protein, 21 aa, Plasmodium falciparum
RKNQMILKNSLNKNLVDCKYC

SEQ ID NO: 3392724 - protein, 37 aa, Plasmodium falciparum
RKNSGLLYPYFKNKSFRLNRYIFIKPIKSVKLNYKKK

SEQ ID NO: 3392725 - protein, 21 aa, Plasmodium falciparum
RKQIIKNIPAHQISKLKDGKN

SEQ ID NO: 3392726 - protein, 25 aa, Plasmodium falciparum
RKQMKKMLLYMKDVINWKSPNHIEV

SEQ ID NO: 3392727 - protein, 31 aa, Plasmodium falciparum
RKQVDIFSFDLILIPLHVGGNHWTLGSIHMK

SEQ ID NO: 3392728 - protein, 29 aa, Plasmodium falciparum
RKQYIEWSTYWPLYFRKPDKDILILTKEE

SEQ ID NO: 3392729 - protein, 25 aa, Plasmodium falciparum
RKRDGKCFRLFTKKSFIDLSDNSIP

SEQ ID NO: 3392730 - protein, 24 aa, Plasmodium falciparum
RKRKVRVYISIQKKKSYPEFFSTN

SEQ ID NO: 3392731 - protein, 25 aa, Plasmodium falciparum
RKRLEYEYLLLMKRWKEIEVENAKK

SEQ ID NO: 3392732 - protein, 23 aa, Plasmodium falciparum
RKRLKNILITKYDRLIIKKKIEE

SEQ ID NO: 3392733 - protein, 17 aa, Plasmodium falciparum
RKSFKRLLGPIEDILHR

SEQ ID NO: 3392734 - protein, 17 aa, Plasmodium falciparum
RKSFVCKKVIKKGIIKS

SEQ ID NO: 3392735 - protein, 17 aa, Plasmodium falciparum
RKSNIIELNKLLKENLR

SEQ ID NO: 3392736 - protein, 28 aa, Plasmodium falciparum
RKSRRSNIVNHLLPFRRSRNFYDTESSD

SEQ ID NO: 3392737 - protein, 19 aa, Plasmodium falciparum
RKTCSLNVIGGFLKSKEKF

SEQ ID NO: 3392738 - protein, 20 aa, Plasmodium falciparum
RKTFIYKYNNMFKVINNDTQ

SEQ ID NO: 3392739 - protein, 19 aa, Plasmodium falciparum
RKYEIIGNILIFHYKYFEC

SEQ ID NO: 3392740 - protein, 23 aa, Plasmodium falciparum
RKYIKCIYVYNKIDMLPIEDINK

SEQ ID NO: 3392741 - protein, 27 aa, Plasmodium falciparum
RKYKKFRFCINKVFKKKSINDIIALNE

SEQ ID NO: 3392742 - protein, 18 aa, Plasmodium falciparum
RKYLRAPAYISIGDPGAG

SEQ ID NO: 3392743 - protein, 23 aa, Plasmodium falciparum
RKYNCLNSFPCLHAPSKIKDSTM

SEQ ID NO: 3392744 - protein, 20 aa, Plasmodium falciparum
RKYQRFITSIKWSTDNTYKL

SEQ ID NO: 3392745 - protein, 29 aa, Plasmodium falciparum
RKYSKLYLSILLFLYLNDEDIQIICSIYK

SEQ ID NO: 3392746 - protein, 17 aa, Plasmodium falciparum
RKYTLITVEEYADILTA

SEQ ID NO: 3392747 - protein, 18 aa, Plasmodium falciparum
RKYYEQIKRIALGYISKI

SEQ ID NO: 3392748 - protein, 30 aa, Plasmodium falciparum
RKYYVNKIRFKLYDPIYQLGKYKNCAGILL

SEQ ID NO: 3392749 - protein, 18 aa, Plasmodium falciparum
RLEDIAHLFLPKQKKHDN

SEQ ID NO: 3392750 - protein, 42 aa, Plasmodium falciparum
RLEKDIINLIMLRQIWCESENLRLLYQFLVVEYQNKSANSVL

SEQ ID NO: 3392751 - protein, 25 aa, Plasmodium falciparum
RLEYQNNIFLNNMLNMYYVCIDYIK

SEQ ID NO: 3392752 - protein, 26 aa, Plasmodium falciparum
RLGDINLLNHFFFEALKEYEKCVDLR

SEQ ID NO: 3392753 - protein, 21 aa, Plasmodium falciparum
RLGGNFRIQWIKMAKIDFDNF

SEQ ID NO: 3392754 - protein, 32 aa, Plasmodium falciparum
RLGKIPPFEFDPPIPLYDLLLVAVNNSYSGFY

SEQ ID NO: 3392755 - protein, 17 aa, Plasmodium falciparum
RLGLALNYSVFFYEILN

SEQ ID NO: 3392756 - protein, 19 aa, Plasmodium falciparum
RLIGYDKLLLCIKRALKWS

SEQ ID NO: 3392757 - protein, 19 aa, Plasmodium falciparum
RLIIFERIYRYICDDIKKE

SEQ ID NO: 3392758 - protein, 36 aa, Plasmodium falciparum
RLKEQAITLPKKIFHDVWLPLGTLSAHWYKRLLDIR

SEQ ID NO: 3392759 - protein, 22 aa, Plasmodium falciparum
RLKFIYDVYYPTTWEMKKEIGS

SEQ ID NO: 3392760 - protein, 17 aa, Plasmodium falciparum
RLKIYRGMGSMEAMYNK

SEQ ID NO: 3392761 - protein, 23 aa, Plasmodium falciparum
RLKKLINYSLKYIANLDIPKKRG

SEQ ID NO: 3392762 - protein, 17 aa, Plasmodium falciparum
RLKLKTKELEKLSQRSE

SEQ ID NO: 3392763 - protein, 25 aa, Plasmodium falciparum
RLKNNIQIVVLLQDGTKLPCNLQAN

SEQ ID NO: 3392764 - protein, 19 aa, Plasmodium falciparum
RLKVRQFIESVDTLNTLKL

SEQ ID NO: 3392765 - protein, 24 aa, Plasmodium falciparum
RLKWNDFNLIYALKNMTLCWSILR

SEQ ID NO: 3392766 - protein, 20 aa, Plasmodium falciparum
RLKYLSMSKNMPKVRGVWFN

SEQ ID NO: 3392767 - protein, 25 aa, Plasmodium falciparum
RLLEERKKKIYLNNYYNMIKSVDRD

SEQ ID NO: 3392768 - protein, 19 aa, Plasmodium falciparum
RLLEPILLTEIICSGDSVS

SEQ ID NO: 3392769 - protein, 30 aa, Plasmodium falciparum
RLLICTCTCYLFMWLPFECAVIKISNDFVC

SEQ ID NO: 3392770 - protein, 24 aa, Plasmodium falciparum
RLLKHIVRCYLRLSENARALEALK

SEQ ID NO: 3392771 - protein, 20 aa, Plasmodium falciparum
RLLSKIKYLKILDPLMETIT

SEQ ID NO: 3392772 - protein, 22 aa, Plasmodium falciparum
RLMGDVPFGILLSGGLDSSIIA

SEQ ID NO: 3392773 - protein, 17 aa, Plasmodium falciparum
RLMILCSGITYVYKDNK

SEQ ID NO: 3392774 - protein, 19 aa, Plasmodium falciparum
RLNINLYNKLINEKEECIN

SEQ ID NO: 3392775 - protein, 24 aa, Plasmodium falciparum
RLNKPQCTALIFKNGRIMLTGTRT

SEQ ID NO: 3392776 - protein, 23 aa, Plasmodium falciparum
RLNLNTILLQMPIGIEQKFKGVY

SEQ ID NO: 3392777 - protein, 24 aa, Plasmodium falciparum
RLNQFTYKIIVFFPTARATSFYAQ

SEQ ID NO: 3392778 - protein, 24 aa, Plasmodium falciparum
RLNVTYMVMSKRKLLTLVNEKYVK

SEQ ID NO: 3392779 - protein, 18 aa, Plasmodium falciparum
RLPELLQMIGRTDPSFLE

SEQ ID NO: 3392780 - protein, 24 aa, Plasmodium falciparum
RLQIYEELKKWRVPHANYVVVDHD

SEQ ID NO: 3392781 - protein, 17 aa, Plasmodium falciparum
RLRLCSKSLIFEAYDVD

SEQ ID NO: 3392782 - protein, 25 aa, Plasmodium falciparum
RLRVDNNLKIFKYNGLIVSRINFEE

SEQ ID NO: 3392783 - protein, 25 aa, Plasmodium falciparum
RLSNYQMNIPLRYVFNNSHELYNEN

SEQ ID NO: 3392784 - protein, 24 aa, Plasmodium falciparum
RLSRLQQRFRMHPIRHHMNNPLNT

SEQ ID NO: 3392785 - protein, 28 aa, Plasmodium falciparum
RLSRNDKYLYEYGYYLNKHMIEINDNIN

SEQ ID NO: 3392786 - protein, 32 aa, Plasmodium falciparum
RLTFLDIQRWKMWLFGLMYYQYKLVNKGNGKK

SEQ ID NO: 3392787 - protein, 22 aa, Plasmodium falciparum
RLTQTNLFKFNGKYENRIIHDD

SEQ ID NO: 3392788 - protein, 17 aa, Plasmodium falciparum
RLVDLDIIVLSSYSLNH

SEQ ID NO: 3392789 - protein, 23 aa, Plasmodium falciparum
RLVELTCYACDLCPIYESKVQKY

SEQ ID NO: 3392790 - protein, 19 aa, Plasmodium falciparum
RLVEPIYLVDISCPQDVVS

SEQ ID NO: 3392791 - protein, 18 aa, Plasmodium falciparum
RLVITPLTSRIYITATQA

SEQ ID NO: 3392792 - protein, 19 aa, Plasmodium falciparum
RLVNNLDSIKLYYESQINK

SEQ ID NO: 3392793 - protein, 20 aa, Plasmodium falciparum
RLYEKGVILGYKRSQRNQDP

SEQ ID NO: 3392794 - protein, 19 aa, Plasmodium falciparum
RLYILSRITYFIHLYTFDE

SEQ ID NO: 3392795 - protein, 27 aa, Plasmodium falciparum
RMDNEQFFKPIIILANKSDDGTSFFSA

SEQ ID NO: 3392796 - protein, 28 aa, Plasmodium falciparum
RMDVNMFHIQKTLDFTIPKNLNDNLKAC

SEQ ID NO: 3392797 - protein, 24 aa, Plasmodium falciparum
RMFENEVFLFYGIKKKSLKNIITY

SEQ ID NO: 3392798 - protein, 17 aa, Plasmodium falciparum
RMKVFKLNIAKLFNILV

SEQ ID NO: 3392799 - protein, 19 aa, Plasmodium falciparum
RMLDMGFSPQIRSIVNDYD

SEQ ID NO: 3392800 - protein, 22 aa, Plasmodium falciparum
RMPADNRLPVSASLKTSEIWKN

SEQ ID NO: 3392801 - protein, 23 aa, Plasmodium falciparum
RMRQFIRFIIEYNNWPFFLDDTI

SEQ ID NO: 3392802 - protein, 25 aa, Plasmodium falciparum
RMRREFTYWYPFDVRISGKDLIFNH

SEQ ID NO: 3392803 - protein, 24 aa, Plasmodium falciparum
RMRSSYGKLMYFLMDTRKEDIYDL

SEQ ID NO: 3392804 - protein, 18 aa, Plasmodium falciparum
RMSDISGLRKNNIGIKVN

SEQ ID NO: 3392805 - protein, 36 aa, Plasmodium falciparum
RMTMKQKNKYIPIKKFNYSYLFIEKKKKNYNSSTRN

SEQ ID NO: 3392806 - protein, 17 aa, Plasmodium falciparum
RMVMKKNKSFPYPHTGY

SEQ ID NO: 3392807 - protein, 17 aa, Plasmodium falciparum
RNAQFIVISLRNQMFEL

SEQ ID NO: 3392808 - protein, 17 aa, Plasmodium falciparum
RNDIFVCTPGRILDLLL

SEQ ID NO: 3392809 - protein, 25 aa, Plasmodium falciparum
RNDIRPEIICILNIRKKNMNNFLIN

SEQ ID NO: 3392810 - protein, 20 aa, Plasmodium falciparum
RNDKYILRKESYKKEYNNIY

SEQ ID NO: 3392811 - protein, 22 aa, Plasmodium falciparum
RNDLINEFFTNSDTLPLNQNNE

SEQ ID NO: 3392812 - protein, 25 aa, Plasmodium falciparum
RNDTKNYVQPIPLLKKSVHRNISHE

SEQ ID NO: 3392813 - protein, 23 aa, Plasmodium falciparum
RNEEHVFHFVLAELGTEGSIAGE

SEQ ID NO: 3392814 - protein, 24 aa, Plasmodium falciparum
RNEKRFCDFLWVTTKSGKGGNPNY

SEQ ID NO: 3392815 - protein, 23 aa, Plasmodium falciparum
RNELNLRNRINCKVIGNIKKENA

SEQ ID NO: 3392816 - protein, 19 aa, Plasmodium falciparum
RNENIRIKPLFYKDDNKDD

SEQ ID NO: 3392817 - protein, 27 aa, Plasmodium falciparum
RNETLFSIFFYLHWDISKNVLYRISKY

SEQ ID NO: 3392818 - protein, 17 aa, Plasmodium falciparum
RNFGYRNNGYRHDRYDR

SEQ ID NO: 3392819 - protein, 19 aa, Plasmodium falciparum
RNFIPPVDILYDDKKVLFL

SEQ ID NO: 3392820 - protein, 25 aa, Plasmodium falciparum
RNGKKDAMWKEYVLLKNKKSKHKYY

SEQ ID NO: 3392821 - protein, 18 aa, Plasmodium falciparum
RNGTFGIQTILKRKENLL

SEQ ID NO: 3392822 - protein, 30 aa, Plasmodium falciparum
RNHIFCVKKSGPFCGFLITIDVEIRKGEHF

SEQ ID NO: 3392823 - protein, 30 aa, Plasmodium falciparum
RNHKKRKLLISNFFPYPLNNMELFISKNNV

SEQ ID NO: 3392824 - protein, 24 aa, Plasmodium falciparum
RNHLDLYQFGEFPKANEAKKFINT

SEQ ID NO: 3392825 - protein, 20 aa, Plasmodium falciparum
RNHMFGIQISKSTILNIDFS

SEQ ID NO: 3392826 - protein, 17 aa, Plasmodium falciparum
RNICNHIILLDLYKNSE

SEQ ID NO: 3392827 - protein, 40 aa, Plasmodium falciparum
RNIDKVFKNYIKKIQRFPSQFIRYSYNGTALYSSCDIFNS

SEQ ID NO: 3392828 - protein, 18 aa, Plasmodium falciparum
RNIEKLFSKGFNVKDKDV

SEQ ID NO: 3392829 - protein, 21 aa, Plasmodium falciparum
RNIFDRGILQLYFNFKKKRYR

SEQ ID NO: 3392830 - protein, 18 aa, Plasmodium falciparum
RNIFKRCFQRIHKNRRRR

SEQ ID NO: 3392831 - protein, 21 aa, Plasmodium falciparum
RNIHQPIQQIYLINNEQFKSI

SEQ ID NO: 3392832 - protein, 17 aa, Plasmodium falciparum
RNIIKNFTFIKFNNAAD

SEQ ID NO: 3392833 - protein, 21 aa, Plasmodium falciparum
RNKCIYILASIIKYIGEKNSK

SEQ ID NO: 3392834 - protein, 33 aa, Plasmodium falciparum
RNKCKHIFITILLYIYEHLFLLPNNTYVIPGNN

SEQ ID NO: 3392835 - protein, 17 aa, Plasmodium falciparum
RNKIELPVFIHSYVWKN

SEQ ID NO: 3392836 - protein, 47 aa, Plasmodium falciparum
RNKIKKKCINKIMSSIFSEKIYKYALIFSPILKNDGCVSLLSVHALK

SEQ ID NO: 3392837 - protein, 20 aa, Plasmodium falciparum
RNKKPLLSIFKKEKNTKPFY

SEQ ID NO: 3392838 - protein, 24 aa, Plasmodium falciparum
RNKLDIYMFEEKYKDNNIIDGDKD

SEQ ID NO: 3392839 - protein, 24 aa, Plasmodium falciparum
RNKLKDIFFYNDQIFFSNYKGNSS

SEQ ID NO: 3392840 - protein, 21 aa, Plasmodium falciparum
RNKLYSFEYQNILEPLGIYIS

SEQ ID NO: 3392841 - protein, 28 aa, Plasmodium falciparum
RNKNIRKILYCNLAMVLIQRKARNDGYL

SEQ ID NO: 3392842 - protein, 23 aa, Plasmodium falciparum
RNKNNCMNNYYPYNNYIDTKEND

SEQ ID NO: 3392843 - protein, 25 aa, Plasmodium falciparum
RNKVAVIMYIWKNKIFGKINKKIED

SEQ ID NO: 3392844 - protein, 19 aa, Plasmodium falciparum
RNLEFLFNSLLKSYQDELI

SEQ ID NO: 3392845 - protein, 31 aa, Plasmodium falciparum
RNLERFKFLKWGMNSFKNMLILPPGSGIVHQ

SEQ ID NO: 3392846 - protein, 25 aa, Plasmodium falciparum
RNLIDKIIYCLDPSYVNNTLDEETK

SEQ ID NO: 3392847 - protein, 24 aa, Plasmodium falciparum
RNLLERVVLLLPLENIFWKKYAHL

SEQ ID NO: 3392848 - protein, 19 aa, Plasmodium falciparum
RNLLNFFQIDRNSILKRKK

SEQ ID NO: 3392849 - protein, 17 aa, Plasmodium falciparum
RNLMLNTQDQNFVLNNM

SEQ ID NO: 3392850 - protein, 17 aa, Plasmodium falciparum
RNLSVLLADEMGLGKTV

SEQ ID NO: 3392851 - protein, 29 aa, Plasmodium falciparum
RNMDKKEIIIFIFNYLFNDTIKELIYLKK

SEQ ID NO: 3392852 - protein, 39 aa, Plasmodium falciparum
RNMFEQYGYVVEVFFPKTYPKVFVRFDNLQSCIKALEQD

SEQ ID NO: 3392853 - protein, 39 aa, Plasmodium falciparum
RNMFRKDMHMMHQELLYFILKFLLKNKKKKIQKDCFLFW

SEQ ID NO: 3392854 - protein, 21 aa, Plasmodium falciparum
RNMLATFLPYIDYKKINIFKI

SEQ ID NO: 3392855 - protein, 26 aa, Plasmodium falciparum
RNMNKLHQFIYNLKKSKIKGIHGMLI

SEQ ID NO: 3392856 - protein, 18 aa, Plasmodium falciparum
RNNDGPISIILTPTRELS

SEQ ID NO: 3392857 - protein, 34 aa, Plasmodium falciparum
RNNHFNTLFKYENKLFILAADISFLHLSCTWELF

SEQ ID NO: 3392858 - protein, 17 aa, Plasmodium falciparum
RNNIYDVLVIPGGMKGS

SEQ ID NO: 3392859 - protein, 35 aa, Plasmodium falciparum
RNNKNKTYPFNYNEPFYFIYKPNKDMSMDHHHHNN

SEQ ID NO: 3392860 - protein, 22 aa, Plasmodium falciparum
RNNNCFINKYYNSKYLNNHQYN

SEQ ID NO: 3392861 - protein, 24 aa, Plasmodium falciparum
RNNQYIIPDALYKLYNNNIEIIHT

SEQ ID NO: 3392862 - protein, 20 aa, Plasmodium falciparum
RNNSLLVNGIFGSGKSTLIC

SEQ ID NO: 3392863 - protein, 39 aa, Plasmodium falciparum
RNPNNDVIYSLIHDMYRDKGPIQIIGHAPYCDDQYIVTN

SEQ ID NO: 3392864 - protein, 20 aa, Plasmodium falciparum
RNQYKIIKKNKIKLSTTSDE

SEQ ID NO: 3392865 - protein, 20 aa, Plasmodium falciparum
RNRESLRDIDRHRDIERYRE

SEQ ID NO: 3392866 - protein, 19 aa, Plasmodium falciparum
RNRFLFCECLIDFIKKKRV

SEQ ID NO: 3392867 - protein, 23 aa, Plasmodium falciparum
RNRNHDLLLSKPFSSMFRRDGYS

SEQ ID NO: 3392868 - protein, 18 aa, Plasmodium falciparum
RNRRASFILNACSNSIII

SEQ ID NO: 3392869 - protein, 18 aa, Plasmodium falciparum
RNRSMSNTLLYKQSKQQN

SEQ ID NO: 3392870 - protein, 23 aa, Plasmodium falciparum
RNRWLCGSILTLLTDLPVVSDLA

SEQ ID NO: 3392871 - protein, 24 aa, Plasmodium falciparum
RNSLFKLKFKWPKDSIFPTYNIFL

SEQ ID NO: 3392872 - protein, 21 aa, Plasmodium falciparum
RNSNYPPTYYPFHTTNNNNNN

SEQ ID NO: 3392873 - protein, 28 aa, Plasmodium falciparum
RNTCISIHFILFSNLLHFHEYSFSQLKH

SEQ ID NO: 3392874 - protein, 39 aa, Plasmodium falciparum
RNTEFKSFKTPTNINVPIAPHVSLMKRDNLRALHLNADQ

SEQ ID NO: 3392875 - protein, 24 aa, Plasmodium falciparum
RNTFQLIPSFLLKNNLRSCLTALF

SEQ ID NO: 3392876 - protein, 26 aa, Plasmodium falciparum
RNTKKGCFMFYFKYDNKTYCVDSTKE

SEQ ID NO: 3392877 - protein, 27 aa, Plasmodium falciparum
RNTNLFIKKIFHIIKNIFQKKDFKEPI

SEQ ID NO: 3392878 - protein, 18 aa, Plasmodium falciparum
RNTPIMHVYMFIHQKENI

SEQ ID NO: 3392879 - protein, 27 aa, Plasmodium falciparum
RNVCTKNIINLIPSLHNIYENKNLCYI

SEQ ID NO: 3392880 - protein, 21 aa, Plasmodium falciparum
RNVHPFLANAYHLLPEQPKRV

SEQ ID NO: 3392881 - protein, 28 aa, Plasmodium falciparum
RNVKKEIFLILCDILGIKNMIPGLEEKD

SEQ ID NO: 3392882 - protein, 18 aa, Plasmodium falciparum
RNWLFNNMSFYLPSKRID

SEQ ID NO: 3392883 - protein, 35 aa, Plasmodium falciparum
RNYDLLYSEFLMNNAEFYIWLDDQIKRYMKGKNDS

SEQ ID NO: 3392884 - protein, 92 aa, Plasmodium falciparum
RNYDRINSYWIRRGNIKQRKAPQILCELCNSKMWVHTWLDDIGSKVKLLCKCGFKNFLKKNNNWVRSPRWKKPVPLIICNSCQQKMYMSQWL

SEQ ID NO: 3392885 - protein, 36 aa, Plasmodium falciparum
RNYSSNQYSIKFVPRHLLYVMSQVASRSFFDPLYRK

SEQ ID NO: 3392886 - protein, 20 aa, Plasmodium falciparum
RPAHLFIPIKSKEAISAYIE

SEQ ID NO: 3392887 - protein, 27 aa, Plasmodium falciparum
RPHIKQLLKRRLRFPALHLPTLQKEYR

SEQ ID NO: 3392888 - protein, 18 aa, Plasmodium falciparum
RPINTSLYLCDNKFHVEA

SEQ ID NO: 3392889 - protein, 18 aa, Plasmodium falciparum
RPKDNYIKFIGYIQEWIV

SEQ ID NO: 3392890 - protein, 20 aa, Plasmodium falciparum
RPLDVRFASYKYNNSNDAQG

SEQ ID NO: 3392891 - protein, 18 aa, Plasmodium falciparum
RPLWRHYYSNTDGLIFVV

SEQ ID NO: 3392892 - protein, 21 aa, Plasmodium falciparum
RPRNIIEFIIDELKILETKRN

SEQ ID NO: 3392893 - protein, 20 aa, Plasmodium falciparum
RPVITAFNQNNLISWRHQQA

SEQ ID NO: 3392894 - protein, 20 aa, Plasmodium falciparum
RPYKEPNMRLYHLPHPTIYP

SEQ ID NO: 3392895 - protein, 27 aa, Plasmodium falciparum
RQCKSCFISIIKSYYPFIKQAQYVSSS

SEQ ID NO: 3392896 - protein, 20 aa, Plasmodium falciparum
RQENELLKSFFSFSNNQSYY

SEQ ID NO: 3392897 - protein, 36 aa, Plasmodium falciparum
RQETFLRRMCLAAFSDIFIAFIHINILRVFCESVLR

SEQ ID NO: 3392898 - protein, 31 aa, Plasmodium falciparum
RQFNEIIWNESFLYYLQTILPPADFMNAWLK

SEQ ID NO: 3392899 - protein, 25 aa, Plasmodium falciparum
RQINKYNLFIINKSSNNSSVFLNDI

SEQ ID NO: 3392900 - protein, 23 aa, Plasmodium falciparum
RQKEKIIFMLWGNFAIKKCKNID

SEQ ID NO: 3392901 - protein, 31 aa, Plasmodium falciparum
RQKELFVAYWLNGIVDLLKRGFKNGNICGSN

SEQ ID NO: 3392902 - protein, 24 aa, Plasmodium falciparum
RQKKKLLRLEKFKKLTKKTKKGQP

SEQ ID NO: 3392903 - protein, 19 aa, Plasmodium falciparum
RQLIEFQGFYFLDKDKRGN

SEQ ID NO: 3392904 - protein, 18 aa, Plasmodium falciparum
RQLLPENLKIFFRFISMM

SEQ ID NO: 3392905 - protein, 24 aa, Plasmodium falciparum
RQNLPKVLQVRRGKFGKQGQSKYT

SEQ ID NO: 3392906 - protein, 19 aa, Plasmodium falciparum
RQPHLNGIYPVFGKVIDGM

SEQ ID NO: 3392907 - protein, 26 aa, Plasmodium falciparum
RQRAANLCFLLYPMNNGKSTVLELFL

SEQ ID NO: 3392908 - protein, 32 aa, Plasmodium falciparum
RQRILMNTLELFLYASILLKSKDINISYIAVD

SEQ ID NO: 3392909 - protein, 52 aa, Plasmodium falciparum
RQTHKVSLFLEKDYSNIFPYAYNNLLFYAFDCYKFYRHIKSKFQDTYKIYEN

SEQ ID NO: 3392910 - protein, 21 aa, Plasmodium falciparum
RQTIFFTATFSDKLKEHIEKY

SEQ ID NO: 3392911 - protein, 20 aa, Plasmodium falciparum
RQTIMFSATFRKEIQVLAKE

SEQ ID NO: 3392912 - protein, 18 aa, Plasmodium falciparum
RQYMNRRGGFNRPLSPTF

SEQ ID NO: 3392913 - protein, 25 aa, Plasmodium falciparum
RQYMYVLQTLYLWREIGEHMFFLWT

SEQ ID NO: 3392914 - protein, 25 aa, Plasmodium falciparum
RRARKMLVKLGLKAIPNVHKVIIKK

SEQ ID NO: 3392915 - protein, 23 aa, Plasmodium falciparum
RRDNELPVLVRWLCKKDIKDQIT

SEQ ID NO: 3392916 - protein, 27 aa, Plasmodium falciparum
RRDVGHEWLIIKLKHPCIIYGIELNFD

SEQ ID NO: 3392917 - protein, 20 aa, Plasmodium falciparum
RREAYRNEAYRHEGYRHEGY

SEQ ID NO: 3392918 - protein, 26 aa, Plasmodium falciparum
RRENDRFWILSFKVNSKLIAAGHDSG

SEQ ID NO: 3392919 - protein, 23 aa, Plasmodium falciparum
RRFEKRIYIPLPNIYARAKIFEK

SEQ ID NO: 3392920 - protein, 20 aa, Plasmodium falciparum
RRFILLIDILYEKNTKVFFY

SEQ ID NO: 3392921 - protein, 20 aa, Plasmodium falciparum
RRFSIMNRKVYSDSVLYFYG

SEQ ID NO: 3392922 - protein, 19 aa, Plasmodium falciparum
RRIIYDPQHLWKCVTVKKD

SEQ ID NO: 3392923 - protein, 20 aa, Plasmodium falciparum
RRILYQLINAIEYLHEIKIV

SEQ ID NO: 3392924 - protein, 26 aa, Plasmodium falciparum
RRIRTIWYCSSLYVEYKNALRKSKKM

SEQ ID NO: 3392925 - protein, 18 aa, Plasmodium falciparum
RRKSVEVILVEKKLKKKK

SEQ ID NO: 3392926 - protein, 35 aa, Plasmodium falciparum
RRKTCLYAHAQNELRELPNLCKTSLCPKLKINELC

SEQ ID NO: 3392927 - protein, 17 aa, Plasmodium falciparum
RRLCYSHHILSLVKRSC

SEQ ID NO: 3392928 - protein, 36 aa, Plasmodium falciparum
RRLDCENLYYQKILVITCLLFDFFQNKKHVNIKSLK

SEQ ID NO: 3392929 - protein, 21 aa, Plasmodium falciparum
RRNIPGFNRPKISPFRGRGMK

SEQ ID NO: 3392930 - protein, 22 aa, Plasmodium falciparum
RRNYNPSYNYNKFDFREKMYND

SEQ ID NO: 3392931 - protein, 22 aa, Plasmodium falciparum
RRQELIDVLYWFNECSPNSDLF

SEQ ID NO: 3392932 - protein, 20 aa, Plasmodium falciparum
RRRKFINVVNYIKKKKKKKL

SEQ ID NO: 3392933 - protein, 22 aa, Plasmodium falciparum
RRRKTFFSFVNKFRNFVVNKIY

SEQ ID NO: 3392934 - protein, 26 aa, Plasmodium falciparum
RRRLAVLLFRLKFVQTIKLAITYIQH

SEQ ID NO: 3392935 - protein, 20 aa, Plasmodium falciparum
RRRLCLDFTLCTLIKDITVA

SEQ ID NO: 3392936 - protein, 21 aa, Plasmodium falciparum
RRRNHILYKCRNKLYNGNVFS

SEQ ID NO: 3392937 - protein, 24 aa, Plasmodium falciparum
RRRNQGFHFFENFTKWCCEITDHN

SEQ ID NO: 3392938 - protein, 22 aa, Plasmodium falciparum
RRRYYSCSRFDKGIYNNDHHID

SEQ ID NO: 3392939 - protein, 27 aa, Plasmodium falciparum
RRVNELLKRNFLQSKSGTFVGSPEMFF

SEQ ID NO: 3392940 - protein, 18 aa, Plasmodium falciparum
RRYLAYDIFSSKGSKNNK

SEQ ID NO: 3392941 - protein, 29 aa, Plasmodium falciparum
RRYLLKRNFPVVYPLNWFNKLSFENISFY

SEQ ID NO: 3392942 - protein, 23 aa, Plasmodium falciparum
RRYLRDYLISTISFKPTGSLCFL

SEQ ID NO: 3392943 - protein, 26 aa, Plasmodium falciparum
RSADMLIRNYLYNDLPYEINQQNLNK

SEQ ID NO: 3392944 - protein, 32 aa, Plasmodium falciparum
RSALHYACAGGYFDICELLIKNGAKVNVSDYK

SEQ ID NO: 3392945 - protein, 25 aa, Plasmodium falciparum
RSATYLLKIEIEKIQKLISCNNWKQ

SEQ ID NO: 3392946 - protein, 17 aa, Plasmodium falciparum
RSCLSHGFHLTSLIGWS

SEQ ID NO: 3392947 - protein, 24 aa, Plasmodium falciparum
RSCNNNIHFLLYKKRNIACLCAKK

SEQ ID NO: 3392948 - protein, 17 aa, Plasmodium falciparum
RSDILNSMFGFHIINET

SEQ ID NO: 3392949 - protein, 19 aa, Plasmodium falciparum
RSDINNTIFITLKNEKKTE

SEQ ID NO: 3392950 - protein, 22 aa, Plasmodium falciparum
RSDLSLLWRQELNELNKLYEKT

SEQ ID NO: 3392951 - protein, 20 aa, Plasmodium falciparum
RSEPIIIQQDKRKIIKINTI

SEQ ID NO: 3392952 - protein, 24 aa, Plasmodium falciparum
RSEPWNVMVDMFLWRDPEQFELKN

SEQ ID NO: 3392953 - protein, 19 aa, Plasmodium falciparum
RSFSIFPNDNEQINSDIYS

SEQ ID NO: 3392954 - protein, 26 aa, Plasmodium falciparum
RSGDKLHCRPFFPFVGKQKDPNHIYK

SEQ ID NO: 3392955 - protein, 22 aa, Plasmodium falciparum
RSHFHLKVSRNYSPPNFSNESI

SEQ ID NO: 3392956 - protein, 25 aa, Plasmodium falciparum
RSILILDLNTLIKYMDFLYDCDIDN

SEQ ID NO: 3392957 - protein, 30 aa, Plasmodium falciparum
RSITYYLEFLIMIVLFFKNPVNILLKGITD

SEQ ID NO: 3392958 - protein, 24 aa, Plasmodium falciparum
RSKNIIFFGIINKCLFLNNKRVFF

SEQ ID NO: 3392959 - protein, 56 aa, Plasmodium falciparum
RSKRWTICPSYICCNSALCRFKLTCNFKFLQFNQAYNTFNIPYAIYNCYKNIMNNY

SEQ ID NO: 3392960 - protein, 39 aa, Plasmodium falciparum
RSKSSSYIKPHRNLTLPINMYMNNTYMYNSKAYVNYENQ

SEQ ID NO: 3392961 - protein, 18 aa, Plasmodium falciparum
RSLELNGKMIYSGNNSFE

SEQ ID NO: 3392962 - protein, 17 aa, Plasmodium falciparum
RSLLSPLSLIQGPPGTG

SEQ ID NO: 3392963 - protein, 28 aa, Plasmodium falciparum
RSLSILCDDGIYRMNFECYKKALKCNEF

SEQ ID NO: 3392964 - protein, 31 aa, Plasmodium falciparum
RSLYHYNIKQFIKWKVYLLNNINICLYGIGS

SEQ ID NO: 3392965 - protein, 18 aa, Plasmodium falciparum
RSNFQKLLVHFRGRLFIG

SEQ ID NO: 3392966 - protein, 36 aa, Plasmodium falciparum
RSNKEKLVAQLLIRWWYVLPDWPPPDYDYKDELYNR

SEQ ID NO: 3392967 - protein, 25 aa, Plasmodium falciparum
RSNKEKNRVIKLPKLNFTNNLESSS

SEQ ID NO: 3392968 - protein, 27 aa, Plasmodium falciparum
RSNKNSYFNYLHKKKKYLKLEDNNNNN

SEQ ID NO: 3392969 - protein, 26 aa, Plasmodium falciparum
RSNNIGYAYTFILPNEYTKAYDIYNL

SEQ ID NO: 3392970 - protein, 35 aa, Plasmodium falciparum
RSNSNICLIFNFIYKFIEILKYFFNNELSGINIVN

SEQ ID NO: 3392971 - protein, 30 aa, Plasmodium falciparum
RSNYNFEKPFLWLARRLSNQPNLVFVGEHA

SEQ ID NO: 3392972 - protein, 18 aa, Plasmodium falciparum
RSRHRRRHRKGRSPSRSR

SEQ ID NO: 3392973 - protein, 17 aa, Plasmodium falciparum
RSRLSICDIDEGRLQEL

SEQ ID NO: 3392974 - protein, 25 aa, Plasmodium falciparum
RSRRRLSYDKYEKRKLRSYSTDSME

SEQ ID NO: 3392975 - protein, 22 aa, Plasmodium falciparum
RSSLYPIVIACLVRKKIKLYNE

SEQ ID NO: 3392976 - protein, 24 aa, Plasmodium falciparum
RSTPARYIRCDLRTFDLGSLDTKF

SEQ ID NO: 3392977 - protein, 19 aa, Plasmodium falciparum
RSVFRLLRLLQVHNGVFVK

SEQ ID NO: 3392978 - protein, 18 aa, Plasmodium falciparum
RSVPLDQKSYVVNPNIFG

SEQ ID NO: 3392979 - protein, 18 aa, Plasmodium falciparum
RSVYNKGSVILLIYDMNN

SEQ ID NO: 3392980 - protein, 33 aa, Plasmodium falciparum
RSYSYNFVHTLKKYIILRDSPYLNEFNINTYTN

SEQ ID NO: 3392981 - protein, 27 aa, Plasmodium falciparum
RTADDCLKRFLYCRAVVLKEKKKLKEV

SEQ ID NO: 3392982 - protein, 40 aa, Plasmodium falciparum
RTCDNNLCCGLLYIPYSYIVVLLNRKIENLTYACTYLRIP

SEQ ID NO: 3392983 - protein, 17 aa, Plasmodium falciparum
RTDVAILLNLRKKIEKL

SEQ ID NO: 3392984 - protein, 25 aa, Plasmodium falciparum
RTEGDNFMMSKMKSILISQNEEIAS

SEQ ID NO: 3392985 - protein, 19 aa, Plasmodium falciparum
RTELQLIDITEDGFVSLLY

SEQ ID NO: 3392986 - protein, 18 aa, Plasmodium falciparum
RTFPIQRFFFVNEYVELE

SEQ ID NO: 3392987 - protein, 17 aa, Plasmodium falciparum
RTFRLQGWHILQEQIML

SEQ ID NO: 3392988 - protein, 28 aa, Plasmodium falciparum
RTGTFCRTLLPLFIPLSIYQYIRQTDKD

SEQ ID NO: 3392989 - protein, 18 aa, Plasmodium falciparum
RTIINKKKLCLVLDLDNT

SEQ ID NO: 3392990 - protein, 26 aa, Plasmodium falciparum
RTIKEDGMIFLTSSRLVFVKNEHSKT

SEQ ID NO: 3392991 - protein, 19 aa, Plasmodium falciparum
RTKEKYFFKPIIQTDIITD

SEQ ID NO: 3392992 - protein, 17 aa, Plasmodium falciparum
RTKLKLRMKDDDKLNKK

SEQ ID NO: 3392993 - protein, 35 aa, Plasmodium falciparum
RTKRNNIFVLLRETPKWFLGWVKTRCFKNSYPKKV

SEQ ID NO: 3392994 - protein, 27 aa, Plasmodium falciparum
RTLKNCATFFFNPIKNIILKHNPDIRY

SEQ ID NO: 3392995 - protein, 20 aa, Plasmodium falciparum
RTLYKKKLFCIILQNHTKYE

SEQ ID NO: 3392996 - protein, 23 aa, Plasmodium falciparum
RTNFVRNKIIYEKLDGLSFCYDN

SEQ ID NO: 3392997 - protein, 46 aa, Plasmodium falciparum
RTNNLLSKVLPVKYLINIFIKLNPIQEALYVLFLKDKKILKNDNTN

SEQ ID NO: 3392998 - protein, 28 aa, Plasmodium falciparum
RTSNSSLLQRHTYPKNFPSPNENTLLTV

SEQ ID NO: 3392999 - protein, 24 aa, Plasmodium falciparum
RTSSAWFLNPAYENYMLEEKKKKR

SEQ ID NO: 3393000 - protein, 24 aa, Plasmodium falciparum
RTVKRKLFRRMYKKYPEYKKRRAR

SEQ ID NO: 3393001 - protein, 25 aa, Plasmodium falciparum
RTVKRLYIVGWIKCRKRFATGHFQG

SEQ ID NO: 3393002 - protein, 24 aa, Plasmodium falciparum
RTVNPPFIDKFKSYNKRFVNIEQR

SEQ ID NO: 3393003 - protein, 19 aa, Plasmodium falciparum
RTVPPALPGVVFLSGGQSE

SEQ ID NO: 3393004 - protein, 24 aa, Plasmodium falciparum
RTVQKLIEMIKTPSQIKKTTKALK

SEQ ID NO: 3393005 - protein, 27 aa, Plasmodium falciparum
RTVSVRSIYLCIHTHSRYIKRSNKYQN

SEQ ID NO: 3393006 - protein, 29 aa, Plasmodium falciparum
RTYQGYMDVIISYLRNLAINYQAAIIYCN

SEQ ID NO: 3393007 - protein, 25 aa, Plasmodium falciparum
RVALVVLDNIYPIKKLCSKLHMSAE

SEQ ID NO: 3393008 - protein, 24 aa, Plasmodium falciparum
RVDAKFDDMIIDRSHDMIVNKVVH

SEQ ID NO: 3393009 - protein, 32 aa, Plasmodium falciparum
RVEKLFLSNILRWAFKIHNFLSISFIYNALAA

SEQ ID NO: 3393010 - protein, 26 aa, Plasmodium falciparum
RVGNIYEIIFFVITNFITLNLREDKN

SEQ ID NO: 3393011 - protein, 20 aa, Plasmodium falciparum
RVGNLWLLNYNKNNLRKIED

SEQ ID NO: 3393012 - protein, 27 aa, Plasmodium falciparum
RVKDMDPFYPMKKVLWMKNISTNTEKL

SEQ ID NO: 3393013 - protein, 21 aa, Plasmodium falciparum
RVKFTFHVIQNVFLVNILPEE

SEQ ID NO: 3393014 - protein, 27 aa, Plasmodium falciparum
RVKGEIGCVIYLNEEPEWFQGFVDSHN

SEQ ID NO: 3393015 - protein, 36 aa, Plasmodium falciparum
RVLIEKFNVPLLYSQIKCLIDTRWLNDEVINFYLSM

SEQ ID NO: 3393016 - protein, 18 aa, Plasmodium falciparum
RVLLFDYVKPSSQGTKWG

SEQ ID NO: 3393017 - protein, 55 aa, Plasmodium falciparum
RVMEIFKRENIMSDDYLLYYMYNNIKLNIDIISKHPYISPLINNNTNILVNVLND

SEQ ID NO: 3393018 - protein, 17 aa, Plasmodium falciparum
RVNIKNTIFSIPKKKYH

SEQ ID NO: 3393019 - protein, 27 aa, Plasmodium falciparum
RVNMKDTYYMKLFIYSSNEIEKIQNNY

SEQ ID NO: 3393020 - protein, 25 aa, Plasmodium falciparum
RVNNILIYITSFYYKNIRDYNMISI

SEQ ID NO: 3393021 - protein, 17 aa, Plasmodium falciparum
RVNPECFCKPSRAILEN

SEQ ID NO: 3393022 - protein, 18 aa, Plasmodium falciparum
RVNRLDELIYKQGQAGIT

SEQ ID NO: 3393023 - protein, 25 aa, Plasmodium falciparum
RVNRYKANFYYFYNNTYDAFALEAN

SEQ ID NO: 3393024 - protein, 18 aa, Plasmodium falciparum
RVNSRLKEIAVGKSTKEY

SEQ ID NO: 3393025 - protein, 18 aa, Plasmodium falciparum
RVQIKKKNLLERSSKLCT

SEQ ID NO: 3393026 - protein, 23 aa, Plasmodium falciparum
RVREYFKKFYKLNNFAIIIFGNF

SEQ ID NO: 3393027 - protein, 18 aa, Plasmodium falciparum
RVTLRIDYEPCICKDYKE

SEQ ID NO: 3393028 - protein, 17 aa, Plasmodium falciparum
RVVSRYFMKLTLSNYGS

SEQ ID NO: 3393029 - protein, 17 aa, Plasmodium falciparum
RVYLLRNKTRGEISFYW

SEQ ID NO: 3393030 - protein, 18 aa, Plasmodium falciparum
RWKIIYPNYLNKKKKVNE

SEQ ID NO: 3393031 - protein, 18 aa, Plasmodium falciparum
RWPAKSCKFLLNILDNVQ

SEQ ID NO: 3393032 - protein, 23 aa, Plasmodium falciparum
RYCTNNKYFNSTFLNYVHNKNNS

SEQ ID NO: 3393033 - protein, 18 aa, Plasmodium falciparum
RYECDFNLLTNQLNDIFS

SEQ ID NO: 3393034 - protein, 18 aa, Plasmodium falciparum
RYEEGSSPLILAKPVFND

SEQ ID NO: 3393035 - protein, 26 aa, Plasmodium falciparum
RYESSSLYRFLLEKASKSMHFALKLS

SEQ ID NO: 3393036 - protein, 18 aa, Plasmodium falciparum
RYEYPHLLLLQHIESQKY

SEQ ID NO: 3393037 - protein, 17 aa, Plasmodium falciparum
RYFSSLDLYIIRKNNIE

SEQ ID NO: 3393038 - protein, 18 aa, Plasmodium falciparum
RYIKGSGSILYYNRKENS

SEQ ID NO: 3393039 - protein, 20 aa, Plasmodium falciparum
RYIKYLAKKYIKMHQIRDFL

SEQ ID NO: 3393040 - protein, 36 aa, Plasmodium falciparum
RYIVLNNIRRKNFTYSFPIIKRNYYIKRHLNCNNKI

SEQ ID NO: 3393041 - protein, 19 aa, Plasmodium falciparum
RYKEIVKLFFEISSCLYYI

SEQ ID NO: 3393042 - protein, 19 aa, Plasmodium falciparum
RYKELYPPVFYFNNNDTLD

SEQ ID NO: 3393043 - protein, 18 aa, Plasmodium falciparum
RYKLLKGLAVRRACYGVL

SEQ ID NO: 3393044 - protein, 19 aa, Plasmodium falciparum
RYLGFRICTLIQHINYSDL

SEQ ID NO: 3393045 - protein, 24 aa, Plasmodium falciparum
RYLKNIFCFPFKDSLPKKMEQNNA

SEQ ID NO: 3393046 - protein, 29 aa, Plasmodium falciparum
RYLKTYESFPLADVLFLIGEIIYGGHITD

SEQ ID NO: 3393047 - protein, 21 aa, Plasmodium falciparum
RYLNNISDFLLSLDYKKKTHD

SEQ ID NO: 3393048 - protein, 20 aa, Plasmodium falciparum
RYMVVEKVIPVLKTSKRESI

SEQ ID NO: 3393049 - protein, 19 aa, Plasmodium falciparum
RYNILLKRKHKYIYDFEVY

SEQ ID NO: 3393050 - protein, 30 aa, Plasmodium falciparum
RYQSPYNRFNIQAGYRWDGVIRGNGFEERR

SEQ ID NO: 3393051 - protein, 17 aa, Plasmodium falciparum
RYRALFRGGYEVLRELL

SEQ ID NO: 3393052 - protein, 17 aa, Plasmodium falciparum
RYRKIIVIPFNDKDVKL

SEQ ID NO: 3393053 - protein, 18 aa, Plasmodium falciparum
RYRLDKPLAQYFHIFTKV

SEQ ID NO: 3393054 - protein, 27 aa, Plasmodium falciparum
RYSISYNRMMTPNLYTGFKRNINNINY

SEQ ID NO: 3393055 - protein, 17 aa, Plasmodium falciparum
RYSNIQSFLIKKLLSYS

SEQ ID NO: 3393056 - protein, 23 aa, Plasmodium falciparum
RYTGNFPYPYMNGLLHIGHAFTL

SEQ ID NO: 3393057 - protein, 17 aa, Plasmodium falciparum
RYYDFYCKYGGNDTFMG

SEQ ID NO: 3393058 - protein, 17 aa, Plasmodium falciparum
RYYMYELVKNNRTIFNY

SEQ ID NO: 3393059 - protein, 26 aa, Plasmodium falciparum
RYYNKIHFNEENYEYFGRGRNYKNCN

SEQ ID NO: 3393060 - protein, 20 aa, Plasmodium falciparum
RYYRDFFEEKILGCGGFGYV

SEQ ID NO: 3393061 - protein, 17 aa, Plasmodium falciparum
SACSKILNIQRKTSFYL

SEQ ID NO: 3393062 - protein, 23 aa, Plasmodium falciparum
SAEPEFFIRIIPDKTNNTLTIED

SEQ ID NO: 3393063 - protein, 22 aa, Plasmodium falciparum
SAFFGNAPIYNIQGRTFKVHIE

SEQ ID NO: 3393064 - protein, 26 aa, Plasmodium falciparum
SAGNDLYVYLWDTLSNKILNRINVND

SEQ ID NO: 3393065 - protein, 38 aa, Plasmodium falciparum
SAHLYSKPVIIVLPLFKLIYVPLYDPLKQNELQPGPSL

SEQ ID NO: 3393066 - protein, 30 aa, Plasmodium falciparum
SAIKEKYNIYLFKQNFRPLFDEYPNGFICT

SEQ ID NO: 3393067 - protein, 24 aa, Plasmodium falciparum
SAKAGLQFPVGRIGRYLKKGKYAK

SEQ ID NO: 3393068 - protein, 18 aa, Plasmodium falciparum
SAKFGLGIKLLSRKIREL

SEQ ID NO: 3393069 - protein, 24 aa, Plasmodium falciparum
SAKSKKYYLCLWAGSSLVATMPTA

SEQ ID NO: 3393070 - protein, 21 aa, Plasmodium falciparum
SALHQIYWNRIILDEAHRIKN

SEQ ID NO: 3393071 - protein, 58 aa, Plasmodium falciparum
SALPHNEAAFFELLNDFFPSLYDIKYLLLNLNIKQLSRTFSLQKISEILSVKRIGRQH

SEQ ID NO: 3393072 - protein, 23 aa, Plasmodium falciparum
SALRRIIEIYSNVTRFILICNYI

SEQ ID NO: 3393073 - protein, 20 aa, Plasmodium falciparum
SALTLEILGDIPDADMKPPE

SEQ ID NO: 3393074 - protein, 17 aa, Plasmodium falciparum
SALYSFESKKFQYINDF

SEQ ID NO: 3393075 - protein, 18 aa, Plasmodium falciparum
SALYYLEQGVNNRKIAFT

SEQ ID NO: 3393076 - protein, 39 aa, Plasmodium falciparum
SAMIDPLLQSISSLPVAPKAYCLCAATWEQISIEGLFPI

SEQ ID NO: 3393077 - protein, 26 aa, Plasmodium falciparum
SANLNTYLQLKMLMSEYANTCVKNDK

SEQ ID NO: 3393078 - protein, 42 aa, Plasmodium falciparum
SANRNKMLYKLMNKNGLIEPYWWFFYNLYENACIHEGSTITN

SEQ ID NO: 3393079 - protein, 25 aa, Plasmodium falciparum
SAQLNNSIKYINTLNNPSLNSNNYM

SEQ ID NO: 3393080 - protein, 17 aa, Plasmodium falciparum
SARKIIMHPDFVEKYLQ

SEQ ID NO: 3393081 - protein, 31 aa, Plasmodium falciparum
SASGSIPPYYMDQSFFMEAMNFLRNTTNNDI

SEQ ID NO: 3393082 - protein, 25 aa, Plasmodium falciparum
SASHKRKVFHYGIHKENLLKGENEF

SEQ ID NO: 3393083 - protein, 21 aa, Plasmodium falciparum
SASIIDGRYDEQKYRMMRLRD

SEQ ID NO: 3393084 - protein, 25 aa, Plasmodium falciparum
SASRKMFESWYLYLDNHTKGLFYLN

SEQ ID NO: 3393085 - protein, 23 aa, Plasmodium falciparum
SASYKRYLKTQDKINIGGNFSNI

SEQ ID NO: 3393086 - protein, 25 aa, Plasmodium falciparum
SATFPNYIQNMAKKLLYKPIEIIVG

SEQ ID NO: 3393087 - protein, 35 aa, Plasmodium falciparum
SAYEDLIDDMPIRFKYIKVKPRSFKLSTDYILNTD

SEQ ID NO: 3393088 - protein, 20 aa, Plasmodium falciparum
SAYFITMNPGYAGRQLLPEN

SEQ ID NO: 3393089 - protein, 17 aa, Plasmodium falciparum
SCDIKWIDFTYSLQQDS

SEQ ID NO: 3393090 - protein, 23 aa, Plasmodium falciparum
SCFELDILLLDDNNIIIPSVKNE

SEQ ID NO: 3393091 - protein, 28 aa, Plasmodium falciparum
SCFGNKMTAALVTFLFVLKNNIRENVNS

SEQ ID NO: 3393092 - protein, 41 aa, Plasmodium falciparum
SCFLPQLERGLYHLFFFFNKERMFIKLLRPGSELSDDIKSI

SEQ ID NO: 3393093 - protein, 31 aa, Plasmodium falciparum
SCGSTALVAVILKGYLIVANAGDSRAIVCFN

SEQ ID NO: 3393094 - protein, 19 aa, Plasmodium falciparum
SCICCARIYLIDKIIKVTS

SEQ ID NO: 3393095 - protein, 18 aa, Plasmodium falciparum
SCILYNFLVNRNSVKKYK

SEQ ID NO: 3393096 - protein, 18 aa, Plasmodium falciparum
SCINLKKRNPIVTILGHV

SEQ ID NO: 3393097 - protein, 25 aa, Plasmodium falciparum
SCIPDIKIFYANCDDILFLGCDGLF

SEQ ID NO: 3393098 - protein, 18 aa, Plasmodium falciparum
SCIVWYMNHYQRFGGSIR

SEQ ID NO: 3393099 - protein, 38 aa, Plasmodium falciparum
SCKHFGYSNSKKISILFLLRWILCGKQIAEKTKRSRLS

SEQ ID NO: 3393100 - protein, 29 aa, Plasmodium falciparum
SCKREKSTKWKYIYQKKSIYKKCLNSRNK

SEQ ID NO: 3393101 - protein, 29 aa, Plasmodium falciparum
SCKYLTCCFANLLEIFNLNYDILFMNSFN

SEQ ID NO: 3393102 - protein, 25 aa, Plasmodium falciparum
SCLIKGILFSYMKYTFLKKEEIKLK

SEQ ID NO: 3393103 - protein, 19 aa, Plasmodium falciparum
SCLKGLNKSSFLSNKIYFS

SEQ ID NO: 3393104 - protein, 19 aa, Plasmodium falciparum
SCLLLQFTDKRFRADHDLT

SEQ ID NO: 3393105 - protein, 18 aa, Plasmodium falciparum
SCLRLISLVLHKSLDNII

SEQ ID NO: 3393106 - protein, 21 aa, Plasmodium falciparum
SCNTFIYTEGCIKPTFFDVIS

SEQ ID NO: 3393107 - protein, 35 aa, Plasmodium falciparum
SCPCRIYEKFILSLLLKYKLIPQCFDLVKVIKCTQ

SEQ ID NO: 3393108 - protein, 25 aa, Plasmodium falciparum
SCPHSSVLWLMLAKQKWLNNEIDKA

SEQ ID NO: 3393109 - protein, 17 aa, Plasmodium falciparum
SCPNCKGPFLMCPNCHC

SEQ ID NO: 3393110 - protein, 25 aa, Plasmodium falciparum
SCSDEKIVILWIEDVTNNVWKNGQI

SEQ ID NO: 3393111 - protein, 29 aa, Plasmodium falciparum
SCSIIKYELRKTSICKYWIKGICANVECN

SEQ ID NO: 3393112 - protein, 26 aa, Plasmodium falciparum
SCSYTDYVYYLLNPSNFFLIEFPNNF

SEQ ID NO: 3393113 - protein, 27 aa, Plasmodium falciparum
SCVEKIKIELLIRKSFDNLDTLTCLWS

SEQ ID NO: 3393114 - protein, 32 aa, Plasmodium falciparum
SCVLNKIIQLYLYLIEFLYPHNMNDAFKYLIN

SEQ ID NO: 3393115 - protein, 26 aa, Plasmodium falciparum
SCVQSKYSWHLLIKKKGNQIIIDKDD

SEQ ID NO: 3393116 - protein, 28 aa, Plasmodium falciparum
SCVYYKSNLYFFGGIDFYSFNSNKINLN

SEQ ID NO: 3393117 - protein, 24 aa, Plasmodium falciparum
SCYELFHILNIFILKLKQFQNIYE

SEQ ID NO: 3393118 - protein, 24 aa, Plasmodium falciparum
SDAMHFLLRVRTWEYRQLPVVHRV

SEQ ID NO: 3393119 - protein, 29 aa, Plasmodium falciparum
SDASLYIELPIPAILKPKELWTGKQLISV

SEQ ID NO: 3393120 - protein, 17 aa, Plasmodium falciparum
SDAYFYDFIFDLSFSIG

SEQ ID NO: 3393121 - protein, 33 aa, Plasmodium falciparum
SDCEPVDFIYFKKHLIFIENKKISLFQAKQNGK

SEQ ID NO: 3393122 - protein, 23 aa, Plasmodium falciparum
SDDCSFVIWDLRTTTISQQNKKS

SEQ ID NO: 3393123 - protein, 23 aa, Plasmodium falciparum
SDDEIIIIYKRFNYISSNGKLNY

SEQ ID NO: 3393124 - protein, 28 aa, Plasmodium falciparum
SDDEIMVVNRKIKSKIYLTPDKKKKNEV

SEQ ID NO: 3393125 - protein, 26 aa, Plasmodium falciparum
SDDVINIILLVELSLRGYQIAIRTNA

SEQ ID NO: 3393126 - protein, 18 aa, Plasmodium falciparum
SDEDIYIWGDNYGNKPNL

SEQ ID NO: 3393127 - protein, 27 aa, Plasmodium falciparum
SDEELYEHFIINTFNYSKPLGCLPPNI

SEQ ID NO: 3393128 - protein, 24 aa, Plasmodium falciparum
SDEFEKMVYGPIFLKCFHLTDRTV

SEQ ID NO: 3393129 - protein, 19 aa, Plasmodium falciparum
SDEFLFPSHLMILCAAASD

SEQ ID NO: 3393130 - protein, 31 aa, Plasmodium falciparum
SDEKKYYYNNYIFNDDLYNGKLNCLTKTLDF

SEQ ID NO: 3393131 - protein, 23 aa, Plasmodium falciparum
SDEKYLELIYQFYGTHQANNNIT

SEQ ID NO: 3393132 - protein, 29 aa, Plasmodium falciparum
SDESYFDSDIDMRIKKLLNIEDHDNFKKK

SEQ ID NO: 3393133 - protein, 27 aa, Plasmodium falciparum
SDEYWDLLTNLLNYVPSERLLACEVLG

SEQ ID NO: 3393134 - protein, 24 aa, Plasmodium falciparum
SDFEPFSSMYYYTGLHNYRTFYLL

SEQ ID NO: 3393135 - protein, 33 aa, Plasmodium falciparum
SDFFQSLKLNINNPHFLIMQGKITKVINMKPIE

SEQ ID NO: 3393136 - protein, 21 aa, Plasmodium falciparum
SDFIVDKYPIGNGRTGLVFKA

SEQ ID NO: 3393137 - protein, 17 aa, Plasmodium falciparum
SDFPYIKEKNSFNSLHY

SEQ ID NO: 3393138 - protein, 19 aa, Plasmodium falciparum
SDFTRLMIGFYNICKVYIK

SEQ ID NO: 3393139 - protein, 25 aa, Plasmodium falciparum
SDGKVSFVEFLVGITKLASSTDDFQ

SEQ ID NO: 3393140 - protein, 21 aa, Plasmodium falciparum
SDHFFFVFFMKRQCLKRSGGF

SEQ ID NO: 3393141 - protein, 27 aa, Plasmodium falciparum
SDHLINYSIDFYFNKLGFNKFHFEETS

SEQ ID NO: 3393142 - protein, 19 aa, Plasmodium falciparum
SDICIFSPDLFWNICLYFK

SEQ ID NO: 3393143 - protein, 21 aa, Plasmodium falciparum
SDIEFIYNKLNLGEGKLYILE

SEQ ID NO: 3393144 - protein, 22 aa, Plasmodium falciparum
SDIELLLNELSESTNSLLSSQK

SEQ ID NO: 3393145 - protein, 19 aa, Plasmodium falciparum
SDILILYNPLCFDEVLNIN

SEQ ID NO: 3393146 - protein, 18 aa, Plasmodium falciparum
SDILWCYCVNKFFDSKFW

SEQ ID NO: 3393147 - protein, 27 aa, Plasmodium falciparum
SDKGNLFISFIFLWNKNQMNKINCLAQ

SEQ ID NO: 3393148 - protein, 26 aa, Plasmodium falciparum
SDKINDLITLLLNEFIRKLQNYIDLS

SEQ ID NO: 3393149 - protein, 30 aa, Plasmodium falciparum
SDKKDNVKILIRYLGWKNYSGCITPNLFKN

SEQ ID NO: 3393150 - protein, 31 aa, Plasmodium falciparum
SDKKKIIDKIINSNFDITLTSTSLASTSIVN

SEQ ID NO: 3393151 - protein, 23 aa, Plasmodium falciparum
SDKSLKYHAVFCINCNNHIAYFE

SEQ ID NO: 3393152 - protein, 30 aa, Plasmodium falciparum
SDKTVKDLIWLLFDTSLLTSGFALEEPTTF

SEQ ID NO: 3393153 - protein, 29 aa, Plasmodium falciparum
SDKWINTVKWLFPSFSKFIDKLHIPIIRT

SEQ ID NO: 3393154 - protein, 27 aa, Plasmodium falciparum
SDLGYRPFIYSWLQKLKDINTYGMTLY

SEQ ID NO: 3393155 - protein, 35 aa, Plasmodium falciparum
SDLRKLAVNLIPFPRLHFFMIGFAPLTSRGSQQYR

SEQ ID NO: 3393156 - protein, 21 aa, Plasmodium falciparum
SDLTPLFKYFPNIINIDLSFN

SEQ ID NO: 3393157 - protein, 19 aa, Plasmodium falciparum
SDMFRLRDKYRRLGKSHSQ

SEQ ID NO: 3393158 - protein, 25 aa, Plasmodium falciparum
SDNGEVYFWSIKDGKLLNVIRSQAR

SEQ ID NO: 3393159 - protein, 30 aa, Plasmodium falciparum
SDNLMSLDLYRPIFFYYMLNYKRNEEFYFF

SEQ ID NO: 3393160 - protein, 24 aa, Plasmodium falciparum
SDNLQMLYDLYDEHYEILRKEKNG

SEQ ID NO: 3393161 - protein, 31 aa, Plasmodium falciparum
SDNNKTWRLTLFYRPYFYLKTKNIHNYEQVT

SEQ ID NO: 3393162 - protein, 24 aa, Plasmodium falciparum
SDNYEYFRRLIVSGFLEARKHSEE

SEQ ID NO: 3393163 - protein, 25 aa, Plasmodium falciparum
SDPIWGLYEIMRCIHFINSCNYIHG

SEQ ID NO: 3393164 - protein, 56 aa, Plasmodium falciparum
SDQIYEKLVDVFTKKLPPCIHSKIENSPFADIIRLCLNYDPNLRPTASEIVQLLNQ

SEQ ID NO: 3393165 - protein, 34 aa, Plasmodium falciparum
SDRIEQYNWFISTLNLRKVYIYEFSRLAFVKTVM

SEQ ID NO: 3393166 - protein, 22 aa, Plasmodium falciparum
SDRINLQHLVGDPTTYFKIGGG

SEQ ID NO: 3393167 - protein, 24 aa, Plasmodium falciparum
SDRKVLIWNINSYNYKPKPKCIVN

SEQ ID NO: 3393168 - protein, 26 aa, Plasmodium falciparum
SDTPGIFQYAAGDIFTFLNIYDKDNT

SEQ ID NO: 3393169 - protein, 18 aa, Plasmodium falciparum
SDTRYFVGTFLSYDRHMN

SEQ ID NO: 3393170 - protein, 22 aa, Plasmodium falciparum
SDTVLYYLCKLFHHFSSIKNVN

SEQ ID NO: 3393171 - protein, 32 aa, Plasmodium falciparum
SDVNCVVWCPQKYQDYFLLATAGDDCVINIWK

SEQ ID NO: 3393172 - protein, 38 aa, Plasmodium falciparum
SDVNKFFEELLCNIKACFLEILDYLKEYCRSKCIQFND

SEQ ID NO: 3393173 - protein, 26 aa, Plasmodium falciparum
SDVPKDIIFFMRVASLLHGLCTQLNV

SEQ ID NO: 3393174 - protein, 36 aa, Plasmodium falciparum
SDVYFYNDIQRWKNTIKVPIWLKKPKDRESLDEFYK

SEQ ID NO: 3393175 - protein, 21 aa, Plasmodium falciparum
SDYAYTLNLNFGLLGGAKKKK

SEQ ID NO: 3393176 - protein, 24 aa, Plasmodium falciparum
SDYFTKYIHPLDKNNLINSYKSDA

SEQ ID NO: 3393177 - protein, 23 aa, Plasmodium falciparum
SDYTYYKCINPFKPNHKYSIMSD

SEQ ID NO: 3393178 - protein, 25 aa, Plasmodium falciparum
SEAINRKLAYIFKQKLPLENKTSFS

SEQ ID NO: 3393179 - protein, 19 aa, Plasmodium falciparum
SEALPLSGFATVGNRRKYN

SEQ ID NO: 3393180 - protein, 21 aa, Plasmodium falciparum
SEALQHPWFKKKKYAFNMDMK

SEQ ID NO: 3393181 - protein, 17 aa, Plasmodium falciparum
SECARLLSLYILGMLKS

SEQ ID NO: 3393182 - protein, 25 aa, Plasmodium falciparum
SEDDVCFYELYKFICSNNIEGNNEN

SEQ ID NO: 3393183 - protein, 33 aa, Plasmodium falciparum
SEDKHNIDLIAKIIFQLLDELTYYNKNTKECNK

SEQ ID NO: 3393184 - protein, 26 aa, Plasmodium falciparum
SEDNKSFEYLLRNMKNKSIEKNFFSI

SEQ ID NO: 3393185 - protein, 23 aa, Plasmodium falciparum
SEDNTLQFWQLKSELLDETNTIP

SEQ ID NO: 3393186 - protein, 25 aa, Plasmodium falciparum
SEDSDLLVYGCPRVLYKLKNTGECN

SEQ ID NO: 3393187 - protein, 26 aa, Plasmodium falciparum
SEDTIYIHINMYNNSAYIYCCEEKAK

SEQ ID NO: 3393188 - protein, 20 aa, Plasmodium falciparum
SEDWKQYKLINLVDDDKLKK

SEQ ID NO: 3393189 - protein, 17 aa, Plasmodium falciparum
SEEGLLSKLLENLKCNK

SEQ ID NO: 3393190 - protein, 28 aa, Plasmodium falciparum
SEEGNVFVTFLFLWNDNLIDKVKLLTQT

SEQ ID NO: 3393191 - protein, 20 aa, Plasmodium falciparum
SEELKALEKLKKLKELKRIE

SEQ ID NO: 3393192 - protein, 23 aa, Plasmodium falciparum
SEENLLAPWLFSCQLGTPLSSLQ

SEQ ID NO: 3393193 - protein, 25 aa, Plasmodium falciparum
SEEQTLLEEGLRIYKNLKNCPEKWT

SEQ ID NO: 3393194 - protein, 29 aa, Plasmodium falciparum
SEEQYHLAFNYWYYPPYIKTNKSANVENK

SEQ ID NO: 3393195 - protein, 17 aa, Plasmodium falciparum
SEETRIKKILYKSKHDP

SEQ ID NO: 3393196 - protein, 28 aa, Plasmodium falciparum
SEFHNMPMLLIYVLEYMKSLLSLNIIPN

SEQ ID NO: 3393197 - protein, 24 aa, Plasmodium falciparum
SEFKRLLHLHFDKFLNRAKANYKR

SEQ ID NO: 3393198 - protein, 25 aa, Plasmodium falciparum
SEFKSKYRILLTGTPLQNNLSELWS

SEQ ID NO: 3393199 - protein, 23 aa, Plasmodium falciparum
SEFSLFHNFIFYKNKNILNEQKG

SEQ ID NO: 3393200 - protein, 26 aa, Plasmodium falciparum
SEGEMIKRIMGISEFSTTYNKCHKST

SEQ ID NO: 3393201 - protein, 17 aa, Plasmodium falciparum
SEGIFYKNLKIVKCVCY

SEQ ID NO: 3393202 - protein, 17 aa, Plasmodium falciparum
SEHFKIFSKALYANDIK

SEQ ID NO: 3393203 - protein, 24 aa, Plasmodium falciparum
SEHIMNDNFLWITRKEEKVLNWST

SEQ ID NO: 3393204 - protein, 28 aa, Plasmodium falciparum
SEIFNEGILFSVRPPKKSWKHIQNLSGG

SEQ ID NO: 3393205 - protein, 17 aa, Plasmodium falciparum
SEIIRCIYAYSLENDLI

SEQ ID NO: 3393206 - protein, 26 aa, Plasmodium falciparum
SEIISPSKFYRLSFYGMEEKNKNEVE

SEQ ID NO: 3393207 - protein, 24 aa, Plasmodium falciparum
SEILSFYLEYLIKSNDQYITFYIN

SEQ ID NO: 3393208 - protein, 20 aa, Plasmodium falciparum
SEILSLICKIYYYVNDSYLI

SEQ ID NO: 3393209 - protein, 24 aa, Plasmodium falciparum
SEINIFLYIIERDGGLKAAAVNTC

SEQ ID NO: 3393210 - protein, 41 aa, Plasmodium falciparum
SEINVSYIGIFTILKKYLYIIKNKKMIFIKKKRYTKKMHSC

SEQ ID NO: 3393211 - protein, 21 aa, Plasmodium falciparum
SEIYMLKELIKEKEKTILYND

SEQ ID NO: 3393212 - protein, 35 aa, Plasmodium falciparum
SEKADIWSLGIILYAMLFGLLPYDSEDKDVKEAYN

SEQ ID NO: 3393213 - protein, 24 aa, Plasmodium falciparum
SEKDILYNEYIINELFNINIDNEN

SEQ ID NO: 3393214 - protein, 26 aa, Plasmodium falciparum
SEKFKLKKMIILLKGTNYMDLQKLNY

SEQ ID NO: 3393215 - protein, 25 aa, Plasmodium falciparum
SEKKKPYKYWYSIEDKMINFYINEY

SEQ ID NO: 3393216 - protein, 25 aa, Plasmodium falciparum
SEKLDYITIFSKYKIFTCGWHKDIS

SEQ ID NO: 3393217 - protein, 36 aa, Plasmodium falciparum; identical to SEQ ID NO: 3371675

SEQ ID NO: 3393218 - protein, 32 aa, Plasmodium falciparum
SEKSSNKSFNGPFLQFLLSDENNEYSSMFYKK

SEQ ID NO: 3393219 - protein, 24 aa, Plasmodium falciparum
SELIEIIGNIKLWIQLNVPRIEDG

SEQ ID NO: 3393220 - protein, 18 aa, Plasmodium falciparum
SELIHNISGLHYYEYIYK

SEQ ID NO: 3393221 - protein, 28 aa, Plasmodium falciparum
SELMKSHMLFLERKLYKIYEKIIYKENI

SEQ ID NO: 3393222 - protein, 29 aa, Plasmodium falciparum
SELYIRKWIYHIIYKKWFTPNNATSTINL

SEQ ID NO: 3393223 - protein, 21 aa, Plasmodium falciparum
SENDILNSCINKNIESFIQEE

SEQ ID NO: 3393224 - protein, 24 aa, Plasmodium falciparum
SENEKDILPVHTFESLSNSNDNIF

SEQ ID NO: 3393225 - protein, 34 aa, Plasmodium falciparum
SENIIIPYNNFRNKCFYFKNSLYFYGGSGYNPNI

SEQ ID NO: 3393226 - protein, 20 aa, Plasmodium falciparum
SENLFMYQKGKKEMKFSIDN

SEQ ID NO: 3393227 - protein, 24 aa, Plasmodium falciparum
SENLRNFMLKHFSPKNMTLIGVNV

SEQ ID NO: 3393228 - protein, 25 aa, Plasmodium falciparum
SENLVSLIEQYFSRIKKEIDMERLE

SEQ ID NO: 3393229 - protein, 25 aa, Plasmodium falciparum
SENNLLIFHYTFEQIIFKTSEAVLK

SEQ ID NO: 3393230 - protein, 18 aa, Plasmodium falciparum
SENNLYFAKFLFQTFNSI

SEQ ID NO: 3393231 - protein, 23 aa, Plasmodium falciparum
SEQILPLYLIEFEFKCLRVDISI

SEQ ID NO: 3393232 - protein, 24 aa, Plasmodium falciparum
SEQKELYRYILESNKKHIEGKEDC

SEQ ID NO: 3393233 - protein, 24 aa, Plasmodium falciparum
SEQKKLLYELYKKEIPKISEHKAY

SEQ ID NO: 3393234 - protein, 25 aa, Plasmodium falciparum
SEQRLPLLPKTWKPTIFLLNESNIF

SEQ ID NO: 3393235 - protein, 25 aa, Plasmodium falciparum
SEQVYISPLALLKILKHGRAGVPME

SEQ ID NO: 3393236 - protein, 34 aa, Plasmodium falciparum
SERDDIMLKFRQCKFRVLISTDIWGRGLDVQEVS

SEQ ID NO: 3393237 - protein, 24 aa, Plasmodium falciparum
SEREKFYFLLQIKEMMETSWLLAQ

SEQ ID NO: 3393238 - protein, 31 aa, Plasmodium falciparum
SEREYEEALAVEKLFFLSSRERCNYCNYGKS

SEQ ID NO: 3393239 - protein, 18 aa, Plasmodium falciparum
SERPTFLQKLAVAKTFKD

SEQ ID NO: 3393240 - protein, 19 aa, Plasmodium falciparum
SERYLTFQTSRSISPEQVE

SEQ ID NO: 3393241 - protein, 27 aa, Plasmodium falciparum
SESGFNDYAFYAERFFEVITGYNSEPD

SEQ ID NO: 3393242 - protein, 25 aa, Plasmodium falciparum
SESKLILHFVKIITSKQKTYNLICL

SEQ ID NO: 3393243 - protein, 24 aa, Plasmodium falciparum
SESKVFYYKMKGDYYRYISEFSCD

SEQ ID NO: 3393244 - protein, 24 aa, Plasmodium falciparum
SETQLRYIFLKEIQSFHADLIIPA

SEQ ID NO: 3393245 - protein, 35 aa, Plasmodium falciparum
SEYALIKYRIIVEIKWLLFLNDKEYFFPKVSEKSL

SEQ ID NO: 3393246 - protein, 26 aa, Plasmodium falciparum
SEYKYLDVPFPNLCDIMNLKRISNDD

SEQ ID NO: 3393247 - protein, 29 aa, Plasmodium falciparum
SEYLTLSDIFIYFQMYKYFHVSSTQYAKY

SEQ ID NO: 3393248 - protein, 18 aa, Plasmodium falciparum
SFCHAMVVIKKFLPKPIL

SEQ ID NO: 3393249 - protein, 66 aa, Plasmodium falciparum
SFCNDKYIIEPIIENTWLKKVLLIIKKESLDIECFLFKIKYYFYKSVLFLYQEGIKSYLGDVANQM

SEQ ID NO: 3393250 - protein, 28 aa, Plasmodium falciparum
SFDDLCEFIYDIYVILNFTVPKNNTDTT

SEQ ID NO: 3393251 - protein, 20 aa, Plasmodium falciparum
SFDINKIIDYLLSKKKLQEA

SEQ ID NO: 3393252 - protein, 26 aa, Plasmodium falciparum
SFDMNIVIKLSFIPRTGEFIYSSIFS

SEQ ID NO: 3393253 - protein, 33 aa, Plasmodium falciparum
SFDNLDTLTCLWSISGQYLIFLVNTNDTTNKSY

SEQ ID NO: 3393254 - protein, 21 aa, Plasmodium falciparum
SFDTFIKIWDSVNFYCTKILC

SEQ ID NO: 3393255 - protein, 35 aa, Plasmodium falciparum
SFEARKGVYYDKSRKLWRANWKENGKIQTKGFSVN

SEQ ID NO: 3393256 - protein, 20 aa, Plasmodium falciparum
SFEHILWVYSGRRGIHCWVA

SEQ ID NO: 3393257 - protein, 27 aa, Plasmodium falciparum
SFEHRLDILIYILKKYHERTIMYEMKR

SEQ ID NO: 3393258 - protein, 41 aa, Plasmodium falciparum
SFENLKKLKVLCVDYLRILKRLTPLWGSTDRTFESHYVNLL

SEQ ID NO: 3393259 - protein, 24 aa, Plasmodium falciparum
SFESFSLKFLKCNYNRLSKLSSEG

SEQ ID NO: 3393260 - protein, 21 aa, Plasmodium falciparum
SFFDLKKYICYYSIANPIIKP

SEQ ID NO: 3393261 - protein, 18 aa, Plasmodium falciparum
SFFFSNMKTPSLVDFCKY

SEQ ID NO: 3393262 - protein, 21 aa, Plasmodium falciparum
SFFKKVWCLFNMFIDNHTLNK

SEQ ID NO: 3393263 - protein, 17 aa, Plasmodium falciparum
SFFLNPLSHYSPSNDMN

SEQ ID NO: 3393264 - protein, 17 aa, Plasmodium falciparum
SFFNLYPQILYDKKLIG

SEQ ID NO: 3393265 - protein, 21 aa, Plasmodium falciparum
SFFSKTPMYRIFVFKDAEFLS

SEQ ID NO: 3393266 - protein, 17 aa, Plasmodium falciparum
SFFVSHHLPMTVCSYSD

SEQ ID NO: 3393267 - protein, 23 aa, Plasmodium falciparum
SFGALILEMLVSKSPAIHVGKNY

SEQ ID NO: 3393268 - protein, 17 aa, Plasmodium falciparum
SFGGEQLWHKTKTIYIK

SEQ ID NO: 3393269 - protein, 25 aa, Plasmodium falciparum
SFGVIMYEVIFKKAPFEKDISPLFF

SEQ ID NO: 3393270 - protein, 31 aa, Plasmodium falciparum
SFHKVYIKLLDDIKGLWFIKTNFSCILEVEL

SEQ ID NO: 3393271 - protein, 18 aa, Plasmodium falciparum
SFHRDVFITLRALDIKNM

SEQ ID NO: 3393272 - protein, 29 aa, Plasmodium falciparum
SFIDNEIIKLLTSNILLKQMIINHNNHIN

SEQ ID NO: 3393273 - protein, 28 aa, Plasmodium falciparum
SFIGQKYCCLLFYPLNYTFVCPTEIIEF

SEQ ID NO: 3393274 - protein, 18 aa, Plasmodium falciparum
SFIHICTLLTKVDFKNLP

SEQ ID NO: 3393275 - protein, 18 aa, Plasmodium falciparum
SFIHQLINDLIHNNLEEE

SEQ ID NO: 3393276 - protein, 25 aa, Plasmodium falciparum
SFINYTDMVYLNNSLFIISSNAHFM

SEQ ID NO: 3393277 - protein, 26 aa, Plasmodium falciparum
SFIQEIQFILEHLKKKIIKKNDYFLN

SEQ ID NO: 3393278 - protein, 18 aa, Plasmodium falciparum
SFKDENVCKYYLIDFCPH

SEQ ID NO: 3393279 - protein, 34 aa, Plasmodium falciparum
SFKDTKLFVHQNISSLILYFNQRSMDDKWVEYLK

SEQ ID NO: 3393280 - protein, 22 aa, Plasmodium falciparum
SFKIQHQIGLIKKSLKSLKNKK

SEQ ID NO: 3393281 - protein, 32 aa, Plasmodium falciparum
SFKLHAIEVHQFIPVPSLPKPRFLDLVPSQQY

SEQ ID NO: 3393282 - protein, 19 aa, Plasmodium falciparum
SFKTLYRSVYNKGSVILLI

SEQ ID NO: 3393283 - protein, 21 aa, Plasmodium falciparum
SFLKEKGLLVLMYHADLTNDQ

SEQ ID NO: 3393284 - protein, 24 aa, Plasmodium falciparum
SFLKNILYFYFTDIDIKKKGKLKY

SEQ ID NO: 3393285 - protein, 17 aa, Plasmodium falciparum
SFLLFPQTKYISNRNFL

SEQ ID NO: 3393286 - protein, 18 aa, Plasmodium falciparum
SFLLQLLNGIAYCHDRRV

SEQ ID NO: 3393287 - protein, 20 aa, Plasmodium falciparum
SFLNQFCIHKIWLKESGEKN

SEQ ID NO: 3393288 - protein, 21 aa, Plasmodium falciparum
SFMGMKSYPVAPPPNINHMIN

SEQ ID NO: 3393289 - protein, 17 aa, Plasmodium falciparum
SFNDSFSLFRSECNKRI

SEQ ID NO: 3393290 - protein, 18 aa, Plasmodium falciparum
SFNFVLNVPIWEGILNTI

SEQ ID NO: 3393291 - protein, 24 aa, Plasmodium falciparum
SFNHNKRFCVFVNTFCKFTYVEDN

SEQ ID NO: 3393292 - protein, 28 aa, Plasmodium falciparum
SFNIYIAQLFIYYFDYKDILPKSKKQNA

SEQ ID NO: 3393293 - protein, 27 aa, Plasmodium falciparum
SFNKFKNKIFLYYPTFIYKKNKKYKNV

SEQ ID NO: 3393294 - protein, 18 aa, Plasmodium falciparum
SFNLLKDVKFCKIGYEKD

SEQ ID NO: 3393295 - protein, 26 aa, Plasmodium falciparum
SFNMKMYFYVLHLWIINKRLRHEQYQ

SEQ ID NO: 3393296 - protein, 19 aa, Plasmodium falciparum
SFNTIFTNSRSTFPKSLSF

SEQ ID NO: 3393297 - protein, 24 aa, Plasmodium falciparum
SFPEIDLSITILLSDVFKGADVIE

SEQ ID NO: 3393298 - protein, 32 aa, Plasmodium falciparum
SFPSSLYILQNYFVKLIILNMKLRDIDSNILN

SEQ ID NO: 3393299 - protein, 17 aa, Plasmodium falciparum
SFQLILITHDNYFVDIL

SEQ ID NO: 3393300 - protein, 18 aa, Plasmodium falciparum
SFQNFYMHIIDEYNKIIN

SEQ ID NO: 3393301 - protein, 18 aa, Plasmodium falciparum
SFRKRYRIVRNNLMKLIK

SEQ ID NO: 3393302 - protein, 29 aa, Plasmodium falciparum
SFSITSLISIPYTNIFISGSYDGYVHFWQ

SEQ ID NO: 3393303 - protein, 18 aa, Plasmodium falciparum
SFSNILLKIIKYKNDTNN

SEQ ID NO: 3393304 - protein, 19 aa, Plasmodium falciparum
SFSRFMSCLFHYPSPIVIV

SEQ ID NO: 3393305 - protein, 33 aa, Plasmodium falciparum
SFSSKNILIKFLRFILNFDWLNNPLIIEYDECD

SEQ ID NO: 3393306 - protein, 27 aa, Plasmodium falciparum
SFSVLKCTYAYILYKYNMDKNYKYINE

SEQ ID NO: 3393307 - protein, 24 aa, Plasmodium falciparum
SFTAFSRLILILRSLHINPQQTKI

SEQ ID NO: 3393308 - protein, 18 aa, Plasmodium falciparum
SFTFLTADKYRLAKDLVK

SEQ ID NO: 3393309 - protein, 24 aa, Plasmodium falciparum
SFVDEFFVKLKPYIEQQQAYLNQL

SEQ ID NO: 3393310 - protein, 18 aa, Plasmodium falciparum
SFYEKFNDIFLFIEDTTK

SEQ ID NO: 3393311 - protein, 18 aa, Plasmodium falciparum
SFYFNINLNYFTCDEILF

SEQ ID NO: 3393312 - protein, 35 aa, Plasmodium falciparum
SFYQNRHIYFDAIFNSYFLKDILQNGKDKGDNYID

SEQ ID NO: 3393313 - protein, 25 aa, Plasmodium falciparum
SGAMKPLCIPLDQPPMPPNMKCFWS

SEQ ID NO: 3393314 - protein, 33 aa, Plasmodium falciparum; identical to SEQ ID NO: 3371788

SEQ ID NO: 3393315 - protein, 25 aa, Plasmodium falciparum
SGERGIFEFLLCDVGVGLSLSVYEK

SEQ ID NO: 3393316 - protein, 20 aa, Plasmodium falciparum
SGGFIWNYMKNIYSSVTSAV

SEQ ID NO: 3393317 - protein, 17 aa, Plasmodium falciparum
SGGIPFPPATASQHCIT

SEQ ID NO: 3393318 - protein, 24 aa, Plasmodium falciparum
SGGKKKYRRLLKNLEIDLSSKIID

SEQ ID NO: 3393319 - protein, 22 aa, Plasmodium falciparum
SGGYKFFNYNLGGVDAQYQRGE

SEQ ID NO: 3393320 - protein, 21 aa, Plasmodium falciparum
SGHLILTKESLLFEPDLRDKN

SEQ ID NO: 3393321 - protein, 19 aa, Plasmodium falciparum
SGHYYSFSYKHNENFWLKC

SEQ ID NO: 3393322 - protein, 22 aa, Plasmodium falciparum
SGIANALRRIMLSEIPTLAIDV

SEQ ID NO: 3393323 - protein, 34 aa, Plasmodium falciparum
SGICINGRCINRYFPVYKFGFEEARRLAIQHRKN

SEQ ID NO: 3393324 - protein, 18 aa, Plasmodium falciparum
SGILFKPGEYLDPSFTVI

SEQ ID NO: 3393325 - protein, 29 aa, Plasmodium falciparum
SGINSNHLTLLLKKLKISLKDIPYAEEDL

SEQ ID NO: 3393326 - protein, 23 aa, Plasmodium falciparum
SGKARDFWSLGCTIYQLVTCTVP

SEQ ID NO: 3393327 - protein, 21 aa, Plasmodium falciparum
SGKGLLKSFMWLIDDITDRID

SEQ ID NO: 3393328 - protein, 20 aa, Plasmodium falciparum
SGKKIFLDTSFQNKKLMVHP

SEQ ID NO: 3393329 - protein, 25 aa, Plasmodium falciparum
SGKRLFHRFMLYSRIGKLFGKFRNV

SEQ ID NO: 3393330 - protein, 22 aa, Plasmodium falciparum
SGKSTFIRLFAGLIKPDNLESL

SEQ ID NO: 3393331 - protein, 26 aa, Plasmodium falciparum
SGKSTLICNIILYLDKILTHEEEEEK

SEQ ID NO: 3393332 - protein, 26 aa, Plasmodium falciparum
SGKTCSFLIPLLIKLNNIYLEKHERE

SEQ ID NO: 3393333 - protein, 28 aa, Plasmodium falciparum
SGKTLAFVLPILERLLQSVNIKMRRNNM

SEQ ID NO: 3393334 - protein, 22 aa, Plasmodium falciparum
SGKYFLITVGRRVVIWKSPCKQ

SEQ ID NO: 3393335 - protein, 22 aa, Plasmodium falciparum
SGLENYIKIWKPHDTVEFVFVI

SEQ ID NO: 3393336 - protein, 26 aa, Plasmodium falciparum
SGLTTNPLLELLIKAGISVIKTDHCG

SEQ ID NO: 3393337 - protein, 27 aa, Plasmodium falciparum
SGNNYHYYNPYNYYNGCTTIDNELNEK

SEQ ID NO: 3393338 - protein, 21 aa, Plasmodium falciparum
SGNVIHTFLNNLYLYKDMENK

SEQ ID NO: 3393339 - protein, 21 aa, Plasmodium falciparum
SGNYKIVNIILKKGADPNYFD

SEQ ID NO: 3393340 - protein, 21 aa, Plasmodium falciparum
SGPCPLLCITNILLLRNQLHI

SEQ ID NO: 3393341 - protein, 17 aa, Plasmodium falciparum
SGRFFHSCSLCLANQGN

SEQ ID NO: 3393342 - protein, 23 aa, Plasmodium falciparum
SGSCNGIINMWNVLDKKLIKKIK

SEQ ID NO: 3393343 - protein, 25 aa, Plasmodium falciparum
SGSEDSLIYIWHKTKGYLLDVINGH

SEQ ID NO: 3393344 - protein, 28 aa, Plasmodium falciparum
SGSKFKPLNKYFLSKIKIVTSLNKIPSP

SEQ ID NO: 3393345 - protein, 28 aa, Plasmodium falciparum
SGSTTHVLWDKLLFNKAKKILGGHVRAM

SEQ ID NO: 3393346 - protein, 27 aa, Plasmodium falciparum
SGTEQRKKLILKKRSVPLDQKSYVVNP

SEQ ID NO: 3393347 - protein, 37 aa, Plasmodium falciparum
SGTGYDWRSDIWSLGVLLYEMLVGDVPFDGTKTQIVE

SEQ ID NO: 3393348 - protein, 23 aa, Plasmodium falciparum
SGTIWVELLYILIKIYNTNLIAN

SEQ ID NO: 3393349 - protein, 23 aa, Plasmodium falciparum
SGTLKQLWLSYNYIDKLDNLQSL

SEQ ID NO: 3393350 - protein, 23 aa, Plasmodium falciparum
SGVGKSCLLLRFADDTYTDSYIS

SEQ ID NO: 3393351 - protein, 35 aa, Plasmodium falciparum
SGYPGVSWNKRMCAWLAFFYDGASRRSRTFHPKHF

SEQ ID NO: 3393352 - protein, 24 aa, Plasmodium falciparum
SHDGLFLIYTIINKIFVIQVKNLE

SEQ ID NO: 3393353 - protein, 19 aa, Plasmodium falciparum
SHDQWIEDIKFYGNLDKWD

SEQ ID NO: 3393354 - protein, 19 aa, Plasmodium falciparum
SHDVIPIYKISKLCKFLVK

SEQ ID NO: 3393355 - protein, 29 aa, Plasmodium falciparum
SHFFDYKNVAILPYFQNLLKFSAHIQQLS

SEQ ID NO: 3393356 - protein, 21 aa, Plasmodium falciparum
SHFFVLRTILCLLVLDKFDQA

SEQ ID NO: 3393357 - protein, 22 aa, Plasmodium falciparum
SHFGYCCIYAFQVKVLPDSVKQ

SEQ ID NO: 3393358 - protein, 25 aa, Plasmodium falciparum
SHFKEENFNLYRKKLSDIKNINGKN

SEQ ID NO: 3393359 - protein, 18 aa, Plasmodium falciparum
SHGYYINNLKINLCSSYD

SEQ ID NO: 3393360 - protein, 20 aa, Plasmodium falciparum
SHIIKNIIYYFYNQNMEDDQ

SEQ ID NO: 3393361 - protein, 30 aa, Plasmodium falciparum
SHIYIMKLHLRVTVNIYKILPLCDINDNIN

SEQ ID NO: 3393362 - protein, 23 aa, Plasmodium falciparum
SHKDILNYFPFKVIALRCLKSPL

SEQ ID NO: 3393363 - protein, 18 aa, Plasmodium falciparum
SHLNLLNLNSQIPNDFKD

SEQ ID NO: 3393364 - protein, 18 aa, Plasmodium falciparum
SHLYLSILYGVWATGKNN

SEQ ID NO: 3393365 - protein, 24 aa, Plasmodium falciparum
SHMNRWIALVFQEDTEILLQEQKA

SEQ ID NO: 3393366 - protein, 25 aa, Plasmodium falciparum
SHNTDYYIIINFPSSLRPFYTMYKE

SEQ ID NO: 3393367 - protein, 43 aa, Plasmodium falciparum
SHRYIIHDYSFINLKQLYLFIFFNIYKYFKYISTPGDAVGSIS

SEQ ID NO: 3393368 - protein, 25 aa, Plasmodium falciparum
SHSLFMNIIFLIKQCLHPLPTCRPT

SEQ ID NO: 3393369 - protein, 19 aa, Plasmodium falciparum
SHSNRLRESIKFEDKKKNN

SEQ ID NO: 3393370 - protein, 19 aa, Plasmodium falciparum
SHSSLCGTLVYFSPEITSG

SEQ ID NO: 3393371 - protein, 28 aa, Plasmodium falciparum
SHVIQSLLCLFPYFNKYEYIYIDKLIIQ

SEQ ID NO: 3393372 - protein, 26 aa, Plasmodium falciparum
SHYISKYNNMFLYMDTDKNKKKNEEN

SEQ ID NO: 3393373 - protein, 38 aa, Plasmodium falciparum
SHYPDIHVIARLLCVILYSRRFFPYYAFNILAGVDENN

SEQ ID NO: 3393374 - protein, 18 aa, Plasmodium falciparum
SHYSHVLQLLLRLRQCCS

SEQ ID NO: 3393375 - protein, 18 aa, Plasmodium falciparum
SIACALVFGLGYNSNILS

SEQ ID NO: 3393376 - protein, 17 aa, Plasmodium falciparum
SIAIPIYSNAHVQIIAH

SEQ ID NO: 3393377 - protein, 30 aa, Plasmodium falciparum
SIAKNDMIYSIKLVPYLVSILKQICENKLP

SEQ ID NO: 3393378 - protein, 33 aa, Plasmodium falciparum
SIANHLIKILLNGLGTPFNICSEYFLSNQNYNK

SEQ ID NO: 3393379 - protein, 30 aa, Plasmodium falciparum
SICARCIRERIMRAFLFEEQKCVRQVLKEK

SEQ ID NO: 3393380 - protein, 26 aa, Plasmodium falciparum
SICAVTKYRIWYKSMHDIGVALLSTV

SEQ ID NO: 3393381 - protein, 31 aa, Plasmodium falciparum
SICPNLYNCKLSKLSILLVLIGGNKINNEYE

SEQ ID NO: 3393382 - protein, 28 aa, Plasmodium falciparum
SICVPPRRRRLYVTPLTKLTGDNTAASQ

SEQ ID NO: 3393383 - protein, 18 aa, Plasmodium falciparum
SICYLCACNFSETVEIWN

SEQ ID NO: 3393384 - protein, 18 aa, Plasmodium falciparum
SIDDPYMKSNYMSPSIIN

SEQ ID NO: 3393385 - protein, 23 aa, Plasmodium falciparum
SIDEPVIPLPYSSAPLKEHINEK

SEQ ID NO: 3393386 - protein, 32 aa, Plasmodium falciparum
SIDLDNKLLNILSLSFLTFVDNVIYDSHIYAQ

SEQ ID NO: 3393387 - protein, 22 aa, Plasmodium falciparum
SIDRGLFRSVFYRTYTSEEKQQ

SEQ ID NO: 3393388 - protein, 29 aa, Plasmodium falciparum
SIDSLKYKYLFLPIIKMLSYVCPTYRLRK

SEQ ID NO: 3393389 - protein, 40 aa, Plasmodium falciparum
SIEENHLDFLQSFNIYKLYNRYLLITNIPTNLRDTHKLKD

SEQ ID NO: 3393390 - protein, 18 aa, Plasmodium falciparum
SIEYIYILKIQDMLNSIK

SEQ ID NO: 3393391 - protein, 24 aa, Plasmodium falciparum
SIEYTLILIFTLLHDPQRPKEKDI

SEQ ID NO: 3393392 - protein, 20 aa, Plasmodium falciparum
SIFENFLYYNLNIPEIIVSD

SEQ ID NO: 3393393 - protein, 29 aa, Plasmodium falciparum
SIFIENLDRYYYFLLNKNKVYYENGEEIK

SEQ ID NO: 3393394 - protein, 31 aa, Plasmodium falciparum
SIFLEKRNYYLKMNMIYILIKKLKHTEEEIV

SEQ ID NO: 3393395 - protein, 21 aa, Plasmodium falciparum
SIFLSFFLFLNICLNENTYKR

SEQ ID NO: 3393396 - protein, 29 aa, Plasmodium falciparum
SIFVENIKKPLLYEIYKKENDTNTNDKII

SEQ ID NO: 3393397 - protein, 17 aa, Plasmodium falciparum
SIFYEHFEFLSSDEYNY

SEQ ID NO: 3393398 - protein, 20 aa, Plasmodium falciparum
SIGCAFIHFENIESATKARK

SEQ ID NO: 3393399 - protein, 21 aa, Plasmodium falciparum
SIGTIMKCKLYNLKKNVYKND

SEQ ID NO: 3393400 - protein, 23 aa, Plasmodium falciparum
SIHGVLQIFNKINTFAMSNNIIN

SEQ ID NO: 3393401 - protein, 22 aa, Plasmodium falciparum
SIHKKPHFLFRENLILDKKEKW

SEQ ID NO: 3393402 - protein, 26 aa, Plasmodium falciparum
SIHKNIVPTKNFYLFNSQDKSNHNCI

SEQ ID NO: 3393403 - protein, 21 aa, Plasmodium falciparum
SIHNNIYLLTSKYMKIITVIL

SEQ ID NO: 3393404 - protein, 32 aa, Plasmodium falciparum
SIHSLTPQHRSYLTNSSYYYHSNHYYSNNSLS

SEQ ID NO: 3393405 - protein, 23 aa, Plasmodium falciparum
SIHTQLLFLYNFCKNYNIHLHKM

SEQ ID NO: 3393406 - protein, 25 aa, Plasmodium falciparum
SIHVEKKYMYAGKIFTIKKKIDKTS

SEQ ID NO: 3393407 - protein, 18 aa, Plasmodium falciparum
SIIDIIWKSILSCPMENR

SEQ ID NO: 3393408 - protein, 18 aa, Plasmodium falciparum
SIIFIYFSHINDISKILH

SEQ ID NO: 3393409 - protein, 19 aa, Plasmodium falciparum
SIIFRIIIQKSSGIEYIYM

SEQ ID NO: 3393410 - protein, 26 aa, Plasmodium falciparum
SIIKNTFLDILSPMKIPFCKINNTNV

SEQ ID NO: 3393411 - protein, 19 aa, Plasmodium falciparum
SIIKPYSITLIRLLRDFFN

SEQ ID NO: 3393412 - protein, 22 aa, Plasmodium falciparum
SIILENLLKNPWYRKHLTTNFE

SEQ ID NO: 3393413 - protein, 18 aa, Plasmodium falciparum
SIILKKKMYQKKSSFLFN

SEQ ID NO: 3393414 - protein, 33 aa, Plasmodium falciparum
SIINDQKVKFFNDNFLKFLKQITNHNINSYNIN

SEQ ID NO: 3393415 - protein, 17 aa, Plasmodium falciparum
SIIYLKQECFNFITHFF

SEQ ID NO: 3393416 - protein, 47 aa, Plasmodium falciparum
SIKHVKKCLPLYKIIKHELFCDFLYSILQIDPTLRPSPAELLKHKFL

SEQ ID NO: 3393417 - protein, 19 aa, Plasmodium falciparum
SIKKILCKYSYVADLYEGD

SEQ ID NO: 3393418 - protein, 30 aa, Plasmodium falciparum
SIKNKMIPIYYILSFLKKLLRIGCLTSYNI

SEQ ID NO: 3393419 - protein, 24 aa, Plasmodium falciparum
SIKNNMMLTLTVPVFRVTHLIKTN

SEQ ID NO: 3393420 - protein, 24 aa, Plasmodium falciparum
SIKRLRFILQYLGEPLTNVEFDEF

SEQ ID NO: 3393421 - protein, 24 aa, Plasmodium falciparum
SIKYIIDIVIYLNSSLYSLNICGN

SEQ ID NO: 3393422 - protein, 33 aa, Plasmodium falciparum
SIKYKNHLCLVFEWMWGNLRIALKKYGNGHGLN

SEQ ID NO: 3393423 - protein, 30 aa, Plasmodium falciparum
SIKYKYFYLPVMKIFSRYFPTFRPGKKKFK

SEQ ID NO: 3393424 - protein, 18 aa, Plasmodium falciparum
SIKYQKLNYPKNLSPKAV

SEQ ID NO: 3393425 - protein, 17 aa, Plasmodium falciparum
SILEDRFPIPKFVLCNS

SEQ ID NO: 3393426 - protein, 19 aa, Plasmodium falciparum
SILGGVREPIQLEARGFFI

SEQ ID NO: 3393427 - protein, 28 aa, Plasmodium falciparum
SILKKFPKYYLINIPKLSFINFISSSEA

SEQ ID NO: 3393428 - protein, 25 aa, Plasmodium falciparum
SILKNIKIMNKINKLNGDIWQYKDP

SEQ ID NO: 3393429 - protein, 17 aa, Plasmodium falciparum
SILKPNSLWSNIGPLLY

SEQ ID NO: 3393430 - protein, 22 aa, Plasmodium falciparum
SILLKPELGFFKKFIESFGGKV

SEQ ID NO: 3393431 - protein, 38 aa, Plasmodium falciparum
SILLRIDNIILKCNLYDFLLYFSFNFIIQNIQSVIPPN

SEQ ID NO: 3393432 - protein, 22 aa, Plasmodium falciparum
SILLSVCSCLKIFPSIRYQNSE

SEQ ID NO: 3393433 - protein, 29 aa, Plasmodium falciparum
SILRELYHKLIFPYYFKFIRAPYERWQFC

SEQ ID NO: 3393434 - protein, 26 aa, Plasmodium falciparum
SILRLARELLLKYKFMEHAFVSRQIN

SEQ ID NO: 3393435 - protein, 17 aa, Plasmodium falciparum
SILSKLLKDKFIIEIQK

SEQ ID NO: 3393436 - protein, 20 aa, Plasmodium falciparum
SILTILTYNGSVYNYNISEN

SEQ ID NO: 3393437 - protein, 20 aa, Plasmodium falciparum
SILTRLLQDSLGGSSKTVFI

SEQ ID NO: 3393438 - protein, 27 aa, Plasmodium falciparum
SILYSKIQKFITIPIPTYDDRIEILEQ

SEQ ID NO: 3393439 - protein, 18 aa, Plasmodium falciparum
SIMAHYLKIFEKEKVFRL

SEQ ID NO: 3393440 - protein, 17 aa, Plasmodium falciparum
SIMAILGSQIKNLNDDI

SEQ ID NO: 3393441 - protein, 27 aa, Plasmodium falciparum
SIMGHKAKILPYSTFRLNLSVTSPYNA

SEQ ID NO: 3393442 - protein, 19 aa, Plasmodium falciparum
SIMIKVNYKRTYRGFTSII

SEQ ID NO: 3393443 - protein, 25 aa, Plasmodium falciparum
SIMNTRYLCNFSLRLVSLSINNDDI

SEQ ID NO: 3393444 - protein, 17 aa, Plasmodium falciparum
SINFYTYSESPLEIEKY

SEQ ID NO: 3393445 - protein, 25 aa, Plasmodium falciparum
SINIPYTKINILLQLYLSNIILNGY

SEQ ID NO: 3393446 - protein, 25 aa, Plasmodium falciparum
SINKDIPFFINYDILLKNCKQDKNY

SEQ ID NO: 3393447 - protein, 31 aa, Plasmodium falciparum
SINKFNHIYNMQNFNHFIPNISNGKNGNLEN

SEQ ID NO: 3393448 - protein, 25 aa, Plasmodium falciparum
SINKHPIYPLLLTGSGTRRFYENND

SEQ ID NO: 3393449 - protein, 25 aa, Plasmodium falciparum
SINMEGFRCILSKMMINYEGDMLVD

SEQ ID NO: 3393450 - protein, 18 aa, Plasmodium falciparum
SINNESIIFIYFSHINDI

SEQ ID NO: 3393451 - protein, 37 aa, Plasmodium falciparum
SINSIYYCLNTKNYIPITLFPSDGLMLICPYFNAYNE

SEQ ID NO: 3393452 - protein, 25 aa, Plasmodium falciparum
SIPDLKRTKLCYKLLKGEKCFNKKC

SEQ ID NO: 3393453 - protein, 24 aa, Plasmodium falciparum
SIPIYLDKHKLIYHVLRVNKKYNF

SEQ ID NO: 3393454 - protein, 20 aa, Plasmodium falciparum
SIQDMSEEGLLSKLLENLKC

SEQ ID NO: 3393455 - protein, 22 aa, Plasmodium falciparum
SIQDMSEEGLLSKLLENLKCNK

SEQ ID NO: 3393456 - protein, 29 aa, Plasmodium falciparum
SIQITKLKQHIVFYKNELRVLKELNADID

SEQ ID NO: 3393457 - protein, 20 aa, Plasmodium falciparum
SIRPYWRCYYKNTNAIIYVI

SEQ ID NO: 3393458 - protein, 37 aa, Plasmodium falciparum
SISEYILLHRDNLKVYLAYYGWKMIKFIETGRQNECR

SEQ ID NO: 3393459 - protein, 18 aa, Plasmodium falciparum
SISIQLILHDLKLQYLKI

SEQ ID NO: 3393460 - protein, 29 aa, Plasmodium falciparum
SISKENDDILWWYKNKKKNNYKDVLTSSY

SEQ ID NO: 3393461 - protein, 24 aa, Plasmodium falciparum
SISKFYPHTPLNEPIHLLVDASLE

SEQ ID NO: 3393462 - protein, 23 aa, Plasmodium falciparum
SISLLDWNPLGHILTSFGDDKLL

SEQ ID NO: 3393463 - protein, 32 aa, Plasmodium falciparum
SISNKSYICYYNYKNIFLKDQLFISPIEHTTS

SEQ ID NO: 3393464 - protein, 17 aa, Plasmodium falciparum
SISNLILNSLKLALSEL

SEQ ID NO: 3393465 - protein, 17 aa, Plasmodium falciparum
SISNTTVNCYKSEFSCY

SEQ ID NO: 3393466 - protein, 22 aa, Plasmodium falciparum
SISPFDYILDYLYGDTSSKKEE

SEQ ID NO: 3393467 - protein, 24 aa, Plasmodium falciparum
SISSSHLLLSYKNKIPYLPHVQHQ

SEQ ID NO: 3393468 - protein, 21 aa, Plasmodium falciparum
SISYSIYFSLLSRLDDMLEML

SEQ ID NO: 3393469 - protein, 23 aa, Plasmodium falciparum
SITDLFASYLFIEKHLYSTLLVN

SEQ ID NO: 3393470 - protein, 17 aa, Plasmodium falciparum
SITIIDFIDMPIGSVCV

SEQ ID NO: 3393471 - protein, 20 aa, Plasmodium falciparum
SITLNYPKYQTTYGNFPFEL

SEQ ID NO: 3393472 - protein, 32 aa, Plasmodium falciparum
SITTMKNYWNNSIANCLPQFIENYSRDVERLN

SEQ ID NO: 3393473 - protein, 27 aa, Plasmodium falciparum
SIVLKKINELSPCAIALLLNSFKKLEI

SEQ ID NO: 3393474 - protein, 29 aa, Plasmodium falciparum
SIVNDAFTILKFIINYLKIPYNNICILCY

SEQ ID NO: 3393475 - protein, 22 aa, Plasmodium falciparum
SIWQGAWIFNTSYTQLLTKKLQ

SEQ ID NO: 3393476 - protein, 17 aa, Plasmodium falciparum
SIYCGGIAEYVMNKRLC

SEQ ID NO: 3393477 - protein, 20 aa, Plasmodium falciparum
SIYKNPYMLLKNAMFNFILH

SEQ ID NO: 3393478 - protein, 29 aa, Plasmodium falciparum
SIYNEQVIYHPTLVPRVSVISPYTPGIIQ

SEQ ID NO: 3393479 - protein, 17 aa, Plasmodium falciparum
SIYNILLNITKINMQKL

SEQ ID NO: 3393480 - protein, 17 aa, Plasmodium falciparum
SIYPHVYKHYKNKGVLF

SEQ ID NO: 3393481 - protein, 27 aa, Plasmodium falciparum
SIYSNDILSYKYCKIERIKKGKCIKSG

SEQ ID NO: 3393482 - protein, 17 aa, Plasmodium falciparum
SKAFVFFIIKNVGVHKI

SEQ ID NO: 3393483 - protein, 24 aa, Plasmodium falciparum
SKAIFSRTLLNKKGYLICIEKDRK

SEQ ID NO: 3393484 - protein, 25 aa, Plasmodium falciparum
SKAKKVPWIYLCRKLKMIEDYHVNY

SEQ ID NO: 3393485 - protein, 18 aa, Plasmodium falciparum
SKANFISAGKICICITSD

SEQ ID NO: 3393486 - protein, 23 aa, Plasmodium falciparum
SKCQLIPIKNNKTEKLWVSVITN

SEQ ID NO: 3393487 - protein, 22 aa, Plasmodium falciparum
SKCYDDILLEDFSGIIITLNTN

SEQ ID NO: 3393488 - protein, 47 aa, Plasmodium falciparum
SKDAGERWLLRDTSTLGTFLKIKPFSNPIPLPIGSIFKAGQCKIEVC

SEQ ID NO: 3393489 - protein, 24 aa, Plasmodium falciparum
SKDGSFFVVASFDSKCSIYKKNNN

SEQ ID NO: 3393490 - protein, 23 aa, Plasmodium falciparum
SKDIYTNVFFFSGNKEKKINNNN

SEQ ID NO: 3393491 - protein, 28 aa, Plasmodium falciparum
SKDKFKIINSYIDYKLNYHKNNKYSYNN

SEQ ID NO: 3393492 - protein, 23 aa, Plasmodium falciparum
SKDKILRYIKKDFFDLYICFIDI

SEQ ID NO: 3393493 - protein, 23 aa, Plasmodium falciparum
SKDLINLCYWMLKKDWKDRPTIY

SEQ ID NO: 3393494 - protein, 23 aa, Plasmodium falciparum
SKDSLIKLWDIRNFKLLYSYKND

SEQ ID NO: 3393495 - protein, 45 aa, Plasmodium falciparum
SKDSNNKFLYIIFSDIDIFPRQCYLILCSYKYMCLNMHYDTDNYS

SEQ ID NO: 3393496 - protein, 26 aa, Plasmodium falciparum
SKEDIHNYPIFNNAKTSQLENSNNDF

SEQ ID NO: 3393497 - protein, 20 aa, Plasmodium falciparum
SKEFFNFCVQLSILSNKCKI

SEQ ID NO: 3393498 - protein, 25 aa, Plasmodium falciparum
SKEKNTFFAFLKKQKYKSVRNYNMK

SEQ ID NO: 3393499 - protein, 38 aa, Plasmodium falciparum
SKEKSISNYNFDKTLFLFYNVLLKVSVHISGLYNTFMD

SEQ ID NO: 3393500 - protein, 18 aa, Plasmodium falciparum
SKELFSNWCPLKIINKGL

SEQ ID NO: 3393501 - protein, 26 aa, Plasmodium falciparum
SKENLEKKIFLLNTKRDELKKEKNNI

SEQ ID NO: 3393502 - protein, 30 aa, Plasmodium falciparum
SKEQINGPYIPYNYKPIYHVEPFSSDVNNN

SEQ ID NO: 3393503 - protein, 34 aa, Plasmodium falciparum
SKETNIELNWACDPLLYEELEWYLSTNNEYLNMT

SEQ ID NO: 3393504 - protein, 18 aa, Plasmodium falciparum
SKFEIFLKTIFRIYSSPG

SEQ ID NO: 3393505 - protein, 24 aa, Plasmodium falciparum
SKGGAMAIILIGTDTTYGPVKNSY

SEQ ID NO: 3393506 - protein, 21 aa, Plasmodium falciparum
SKGSMFSFFKLRHSKVENEGD

SEQ ID NO: 3393507 - protein, 18 aa, Plasmodium falciparum
SKGTSRIFKKIKTNKNYG

SEQ ID NO: 3393508 - protein, 22 aa, Plasmodium falciparum
SKHVFLCTVVCSRMLKKLCEKY

SEQ ID NO: 3393509 - protein, 30 aa, Plasmodium falciparum
SKIALMQKLQRDSIIDPNIPSRYATGANAI

SEQ ID NO: 3393510 - protein, 22 aa, Plasmodium falciparum
SKIGCIYFIGMSTNMYRGKIIV

SEQ ID NO: 3393511 - protein, 22 aa, Plasmodium falciparum
SKIHVFLINNPKENDKKKEDAL

SEQ ID NO: 3393512 - protein, 22 aa, Plasmodium falciparum
SKIMGPIYNDIPRNITGNLNSD

SEQ ID NO: 3393513 - protein, 27 aa, Plasmodium falciparum
SKINEAQALLIFQKIKEKLKKNKNFIK

SEQ ID NO: 3393514 - protein, 26 aa, Plasmodium falciparum
SKIRDLFICSWKYFSFELPYYSADIH

SEQ ID NO: 3393515 - protein, 21 aa, Plasmodium falciparum
SKIWDLRNFKSLFTFGNGLSC

SEQ ID NO: 3393516 - protein, 24 aa, Plasmodium falciparum
SKIYLAILYGHLPLDILHINTPIS

SEQ ID NO: 3393517 - protein, 39 aa, Plasmodium falciparum
SKKIKIVYVIEFLNIKIAKMFFTLINKTVFQNFLKDQNV

SEQ ID NO: 3393518 - protein, 21 aa, Plasmodium falciparum
SKKIWSCYLQILHNTFKDEEY

SEQ ID NO: 3393519 - protein, 27 aa, Plasmodium falciparum
SKKKFLLFYINFLLEKGYINNIRTLIY

SEQ ID NO: 3393520 - protein, 35 aa, Plasmodium falciparum
SKKKNIPVIINKECTIFIVPIKEEYLKDLQIENME

SEQ ID NO: 3393521 - protein, 23 aa, Plasmodium falciparum
SKKKPLGLIIRRNICGRLQKKYG

SEQ ID NO: 3393522 - protein, 26 aa, Plasmodium falciparum
SKKNEPFVLRLPFPASFRGLKDEQLQ

SEQ ID NO: 3393523 - protein, 24 aa, Plasmodium falciparum
SKKNNIFILSKNKIFYYQIHTNIL

SEQ ID NO: 3393524 - protein, 23 aa, Plasmodium falciparum
SKKNYYDIIKEKFTFNRESKKVS

SEQ ID NO: 3393525 - protein, 22 aa, Plasmodium falciparum
SKKRFLYLDHINLPIEVFVCKN

SEQ ID NO: 3393526 - protein, 28 aa, Plasmodium falciparum
SKKRIEDRKLWLQNFILGSYVDHKEKDL

SEQ ID NO: 3393527 - protein, 31 aa, Plasmodium falciparum
SKKSYELLRFLFDLYKNIYIKYLNGQDKEMV

SEQ ID NO: 3393528 - protein, 22 aa, Plasmodium falciparum
SKKTKKLLKRPSVMKLKEFAPK

SEQ ID NO: 3393529 - protein, 34 aa, Plasmodium falciparum
SKLEPVYPYISNNLFFLFEYYYNYLVNMIKNVKL

SEQ ID NO: 3393530 - protein, 38 aa, Plasmodium falciparum
SKLLLSGTPLHNNLEELWTLLHFLNPQQYTYYETFQKK

SEQ ID NO: 3393531 - protein, 24 aa, Plasmodium falciparum
SKLNRSNVIHPRQSYKATYENKKF

SEQ ID NO: 3393532 - protein, 26 aa, Plasmodium falciparum
SKLPESLKILFRPITVIIPDFNKICE

SEQ ID NO: 3393533 - protein, 27 aa, Plasmodium falciparum
SKMSSSKCCIYLVAPFECVQKLLADGC

SEQ ID NO: 3393534 - protein, 33 aa, Plasmodium falciparum
SKMYNVNFCIKKYLRNMKYVNLKRLKTINEKNC

SEQ ID NO: 3393535 - protein, 27 aa, Plasmodium falciparum
SKNADNLLPYLFYYKNNQNSSSQPYMY

SEQ ID NO: 3393536 - protein, 26 aa, Plasmodium falciparum
SKNESLPTYILQYEQLRKNECVYFNI

SEQ ID NO: 3393537 - protein, 28 aa, Plasmodium falciparum
SKNIDKICEWIFELITIGNKLYCSTFDG

SEQ ID NO: 3393538 - protein, 23 aa, Plasmodium falciparum
SKNIQRPLLILADRQIDLSVMIQ

SEQ ID NO: 3393539 - protein, 25 aa, Plasmodium falciparum
SKNKLTYVEKIYPTNYHYINNYNKN

SEQ ID NO: 3393540 - protein, 26 aa, Plasmodium falciparum
SKNKTKLFDMLKYLSSIKYKSNNNIL

SEQ ID NO: 3393541 - protein, 20 aa, Plasmodium falciparum
SKNLICPITKKPLKMNELIT

SEQ ID NO: 3393542 - protein, 29 aa, Plasmodium falciparum
SKNNNIILLLFRIFFNYIITLNENNDKEL

SEQ ID NO: 3393543 - protein, 28 aa, Plasmodium falciparum
SKNNNMIIKKINMKMLPMVTKKALPKSK

SEQ ID NO: 3393544 - protein, 28 aa, Plasmodium falciparum
SKNVYQAYLLEPFFKRKNKALLDIILLK

SEQ ID NO: 3393545 - protein, 24 aa, Plasmodium falciparum
SKNYLLYYTPWPKNNTKEFDLWIK

SEQ ID NO: 3393546 - protein, 32 aa, Plasmodium falciparum
SKNYNQILRYSYNGKFLYMFKSTKTNIKQKNM

SEQ ID NO: 3393547 - protein, 21 aa, Plasmodium falciparum
SKPLVLCEPLFLNLEHIIIDQ

SEQ ID NO: 3393548 - protein, 24 aa, Plasmodium falciparum
SKPSKFMEIILKNVKEKKQEKKTC

SEQ ID NO: 3393549 - protein, 31 aa, Plasmodium falciparum
SKPVESKFGSYILQKFGWEKGKGLGKHENGD

SEQ ID NO: 3393550 - protein, 36 aa, Plasmodium falciparum
SKQHAVIQFKKHESKILPFLLDLNSTNGTYINNEKI

SEQ ID NO: 3393551 - protein, 28 aa, Plasmodium falciparum
SKQKKINKIFYPTNIYKRMYQKIKENNK

SEQ ID NO: 3393552 - protein, 27 aa, Plasmodium falciparum
SKQVLKYLTYLSYFQKGYKKKKKKMIP

SEQ ID NO: 3393553 - protein, 20 aa, Plasmodium falciparum
SKRCNAMEALKHPWLQPNLY

SEQ ID NO: 3393554 - protein, 21 aa, Plasmodium falciparum
SKREYNMSIALSKFNNYTFKE

SEQ ID NO: 3393555 - protein, 18 aa, Plasmodium falciparum
SKRFIELKQFMAESKLLL

SEQ ID NO: 3393556 - protein, 23 aa, Plasmodium falciparum
SKRFKMISIYGYKLALKNYSKIS

SEQ ID NO: 3393557 - protein, 22 aa, Plasmodium falciparum
SKRGYILTEINLEQVLKGLNLT

SEQ ID NO: 3393558 - protein, 20 aa, Plasmodium falciparum
SKRVTLLPLEDCVISREVHE

SEQ ID NO: 3393559 - protein, 24 aa, Plasmodium falciparum
SKSLDFMMPPNLGLGNRTQLKKDI

SEQ ID NO: 3393560 - protein, 26 aa, Plasmodium falciparum
SKSLWINVCRFIWESSIKLNRERRRK

SEQ ID NO: 3393561 - protein, 37 aa, Plasmodium falciparum
SKSRNYNYYNIMKNYYFAFFLDLYKNNEDSKKSSNSD

SEQ ID NO: 3393562 - protein, 23 aa, Plasmodium falciparum
SKSWFIVETSKNYKFFYNKKSNE

SEQ ID NO: 3393563 - protein, 25 aa, Plasmodium falciparum
SKTENLRIIKLVDLAYNNDPRIIAE

SEQ ID NO: 3393564 - protein, 21 aa, Plasmodium falciparum
SKTNLFDEFILNHNNSPLSLN

SEQ ID NO: 3393565 - protein, 21 aa, Plasmodium falciparum
SKVIIINLSYALLSRFDLVVI

SEQ ID NO: 3393566 - protein, 20 aa, Plasmodium falciparum
SKYCLFIGSNKRSLILKNFM

SEQ ID NO: 3393567 - protein, 41 aa, Plasmodium falciparum
SKYDDNFFNPFLNKKYDGLGKLPYIQNKPIPNGLHISIYIP

SEQ ID NO: 3393568 - protein, 26 aa, Plasmodium falciparum
SKYDKELFYIYHKLNQWKKYLSIIKN

SEQ ID NO: 3393569 - protein, 20 aa, Plasmodium falciparum
SKYGLFYYLIHHNSSHIALK

SEQ ID NO: 3393570 - protein, 21 aa, Plasmodium falciparum
SKYIGYWRRGKANRYGIFIHP

SEQ ID NO: 3393571 - protein, 32 aa, Plasmodium falciparum
SKYINLHLEERLYFVLTSLYFSMNIQLTNFSN

SEQ ID NO: 3393572 - protein, 20 aa, Plasmodium falciparum
SKYKKCIIPFISINIDFYIR

SEQ ID NO: 3393573 - protein, 24 aa, Plasmodium falciparum
SKYKKSLLSCFLLKQFQGISSGNT

SEQ ID NO: 3393574 - protein, 18 aa, Plasmodium falciparum
SKYNSYFMSSKDKHVVEQ

SEQ ID NO: 3393575 - protein, 21 aa, Plasmodium falciparum
SKYPWIKYDSEIDPFQYSEGL

SEQ ID NO: 3393576 - protein, 36 aa, Plasmodium falciparum
SKYSYLNILIMYYIKRMETFLPFFNLQDYLQILQIY

SEQ ID NO: 3393577 - protein, 20 aa, Plasmodium falciparum
SLAKYTLIVNVPPNTTRKDL

SEQ ID NO: 3393578 - protein, 27 aa, Plasmodium falciparum
SLAVEVDLSGCFFFHSSFTCPISRDKS

SEQ ID NO: 3393579 - protein, 18 aa, Plasmodium falciparum
SLCFSPCDYWLCAATDRF

SEQ ID NO: 3393580 - protein, 29 aa, Plasmodium falciparum
SLCKAMYEKLFLWIIRHLNSRIEPEGGFK

SEQ ID NO: 3393581 - protein, 33 aa, Plasmodium falciparum
SLCNENIKKIDFYILKIILNELDELRKVNEPHY

SEQ ID NO: 3393582 - protein, 24 aa, Plasmodium falciparum
SLCYEFLLIFYKNKISNYYFLKKA

SEQ ID NO: 3393583 - protein, 24 aa, Plasmodium falciparum
SLDAYRRSFFRLVDLDIIVLSSYS

SEQ ID NO: 3393584 - protein, 35 aa, Plasmodium falciparum
SLDDCYLHFAVKVLRYFWPNFKYKFGSEEFAVNEY

SEQ ID NO: 3393585 - protein, 18 aa, Plasmodium falciparum
SLDDDICYDNFLFEKGEE

SEQ ID NO: 3393586 - protein, 28 aa, Plasmodium falciparum
SLDEFYKNIIKKLLRVKNKIRAYKIQEA

SEQ ID NO: 3393587 - protein, 25 aa, Plasmodium falciparum
SLDKFNKIAFMKKLKKNNPLYYNQQ

SEQ ID NO: 3393588 - protein, 25 aa, Plasmodium falciparum
SLDNKKFVYIIKSDDLYFVTLIEGE

SEQ ID NO: 3393589 - protein, 32 aa, Plasmodium falciparum
SLDTKFDVILIDPPWKEYYDRKIHNLHVLNNI

SEQ ID NO: 3393590 - protein, 18 aa, Plasmodium falciparum
SLDYYKKVIIKLKNNINN

SEQ ID NO: 3393591 - protein, 27 aa, Plasmodium falciparum
SLECLGLENFIKLTKKNLFIKKSDEKK

SEQ ID NO: 3393592 - protein, 19 aa, Plasmodium falciparum
SLEDYLIFIIKDNIKLRKD

SEQ ID NO: 3393593 - protein, 25 aa, Plasmodium falciparum
SLEEKPYIKFYWKNKKYKNYLKYFT

SEQ ID NO: 3393594 - protein, 24 aa, Plasmodium falciparum
SLEFTYPYRYESNRNIFLIINSEN

SEQ ID NO: 3393595 - protein, 27 aa, Plasmodium falciparum
SLEKQQFVFVLLMNVLKKIIQSEESII

SEQ ID NO: 3393596 - protein, 27 aa, Plasmodium falciparum
SLEKVREYWWAIHRKELWEALTCNAPK

SEQ ID NO: 3393597 - protein, 28 aa, Plasmodium falciparum
SLETICLLLAYKIKYPENFFLLRGNHEC

SEQ ID NO: 3393598 - protein, 27 aa, Plasmodium falciparum
SLFDSFYWDYLQIPLQPLKDNLSSQTY

SEQ ID NO: 3393599 - protein, 31 aa, Plasmodium falciparum
SLFNKIKLQIFMYMILNNYRIKILVNSLSAL

SEQ ID NO: 3393600 - protein, 19 aa, Plasmodium falciparum
SLFNMYKNKFNIQIKQQEE

SEQ ID NO: 3393601 - protein, 22 aa, Plasmodium falciparum
SLFSSIRYYYYCDNNVFLSTDD

SEQ ID NO: 3393602 - protein, 30 aa, Plasmodium falciparum
SLGCILYEMLFCERPFQFNYLEKCSKELLV

SEQ ID NO: 3393603 - protein, 24 aa, Plasmodium falciparum
SLGIELLHFGEVIMSSGLVMNEDV

SEQ ID NO: 3393604 - protein, 19 aa, Plasmodium falciparum
SLGIILYELISLKPPFKSN

SEQ ID NO: 3393605 - protein, 24 aa, Plasmodium falciparum
SLGKYIFCKAYRRIYKNNQSKEKD

SEQ ID NO: 3393606 - protein, 26 aa, Plasmodium falciparum
SLGLDAKNPMIFRMIADLEKDGYSSI

SEQ ID NO: 3393607 - protein, 17 aa, Plasmodium falciparum
SLGLKHSIKTLLVPGAG

SEQ ID NO: 3393608 - protein, 18 aa, Plasmodium falciparum
SLGNVLENIKRPSQYMNN

SEQ ID NO: 3393609 - protein, 29 aa, Plasmodium falciparum
SLGVCFYNYLKYEFLMTEFIDNGHFTALE

SEQ ID NO: 3393610 - protein, 43 aa, Plasmodium falciparum
SLHDSHILELVKILKKIIKIVYNTYYCLNIDLSENYITCIGLK

SEQ ID NO: 3393611 - protein, 24 aa, Plasmodium falciparum
SLHFMNLPIYLDKSRNSFIGFWNF

SEQ ID NO: 3393612 - protein, 23 aa, Plasmodium falciparum
SLHGNFPPTFYKLTCDHIFHLMC

SEQ ID NO: 3393613 - protein, 19 aa, Plasmodium falciparum
SLHKKTINPIYNFKEKNNK

SEQ ID NO: 3393614 - protein, 19 aa, Plasmodium falciparum
SLIDLCGLQLCIRDNEMFF

SEQ ID NO: 3393615 - protein, 19 aa, Plasmodium falciparum
SLIIFPVNIHEYGNKYIAV

SEQ ID NO: 3393616 - protein, 25 aa, Plasmodium falciparum
SLIINPKCHFLITSYTPITIDKHIS

SEQ ID NO: 3393617 - protein, 17 aa, Plasmodium falciparum
SLIKESLEYGELLLSNV

SEQ ID NO: 3393618 - protein, 17 aa, Plasmodium falciparum
SLILFRYINAYISYDNN

SEQ ID NO: 3393619 - protein, 17 aa, Plasmodium falciparum
SLILIVLDVLKPLTYKK

SEQ ID NO: 3393620 - protein, 18 aa, Plasmodium falciparum
SLIPYTFIYDVDGGERCV

SEQ ID NO: 3393621 - protein, 20 aa, Plasmodium falciparum
SLIRKILSNFTLIINKIRRD

SEQ ID NO: 3393622 - protein, 18 aa, Plasmodium falciparum
SLISNYFSELLDKKKKKD

SEQ ID NO: 3393623 - protein, 20 aa, Plasmodium falciparum
SLISTLRLFNCLFNFRNSCI

SEQ ID NO: 3393624 - protein, 28 aa, Plasmodium falciparum
SLITCQIPVNFIFETTIKYLLRGNYDAK

SEQ ID NO: 3393625 - protein, 17 aa, Plasmodium falciparum
SLKCKVYDELDTCLKCI

SEQ ID NO: 3393626 - protein, 24 aa, Plasmodium falciparum
SLKCLLPCHPYLNSEWSFASYKLP

SEQ ID NO: 3393627 - protein, 22 aa, Plasmodium falciparum
SLKDFYELYLTIYPSHIYKPNL

SEQ ID NO: 3393628 - protein, 26 aa, Plasmodium falciparum
SLKDGKLILLLDLDNTLLQATSFAKF

SEQ ID NO: 3393629 - protein, 24 aa, Plasmodium falciparum
SLKGEYFYKRISTCLIKSSLVKDY

SEQ ID NO: 3393630 - protein, 25 aa, Plasmodium falciparum
SLKKIEDIFLFKRNIFNKETIYYSI

SEQ ID NO: 3393631 - protein, 27 aa, Plasmodium falciparum
SLKRPPMYPTKFFGCELGTMVKFEENE

SEQ ID NO: 3393632 - protein, 22 aa, Plasmodium falciparum
SLKVRVLTSFFYIPDKLRKESE

SEQ ID NO: 3393633 - protein, 19 aa, Plasmodium falciparum
SLLPNSWTEKALCNICNIG

SEQ ID NO: 3393634 - protein, 20 aa, Plasmodium falciparum
SLLSMAIFTTVYLSYIHCNL

SEQ ID NO: 3393635 - protein, 19 aa, Plasmodium falciparum
SLLYEFLSKDKQYIIDLRE

SEQ ID NO: 3393636 - protein, 19 aa, Plasmodium falciparum
SLLYINDQICIFQKDIQNE

SEQ ID NO: 3393637 - protein, 26 aa, Plasmodium falciparum
SLMDKELFFNTSDNLFLISLDSEIIK

SEQ ID NO: 3393638 - protein, 19 aa, Plasmodium falciparum
SLMDTILFNIHSCSELNQA

SEQ ID NO: 3393639 - protein, 21 aa, Plasmodium falciparum
SLMNTDWPKIIFESVRCLKKG

SEQ ID NO: 3393640 - protein, 26 aa, Plasmodium falciparum
SLMVDHNLHLFKYYDQQKNYYTSQKR

SEQ ID NO: 3393641 - protein, 19 aa, Plasmodium falciparum
SLMVGYFRDEELTKKCFDE

SEQ ID NO: 3393642 - protein, 23 aa, Plasmodium falciparum
SLNDYIYKLLIRRFKRKKEKQEL

SEQ ID NO: 3393643 - protein, 23 aa, Plasmodium falciparum
SLNIIPNRILQTFIFDLCIFFKQ

SEQ ID NO: 3393644 - protein, 19 aa, Plasmodium falciparum
SLNIMQNINIPQKNNFTLN

SEQ ID NO: 3393645 - protein, 26 aa, Plasmodium falciparum
SLNLNKHPLFPWFNTNLKDVLNTYIK

SEQ ID NO: 3393646 - protein, 20 aa, Plasmodium falciparum
SLNLYIYNELLRKDLKINHM

SEQ ID NO: 3393647 - protein, 24 aa, Plasmodium falciparum
SLNNNILGWEFGGGAPQNGAAEDK

SEQ ID NO: 3393648 - protein, 21 aa, Plasmodium falciparum
SLNPLFKSKMKIEKKNPPILI

SEQ ID NO: 3393649 - protein, 21 aa, Plasmodium falciparum
SLNSCIYAKVLRLSWLDNKTG

SEQ ID NO: 3393650 - protein, 21 aa, Plasmodium falciparum
SLPHILPGHKYSYNPPPELML

SEQ ID NO: 3393651 - protein, 20 aa, Plasmodium falciparum
SLPVLYTKNLLRKTKTRKDT

SEQ ID NO: 3393652 - protein, 17 aa, Plasmodium falciparum
SLQDKIMYNPMNDYNCI

SEQ ID NO: 3393653 - protein, 19 aa, Plasmodium falciparum
SLQFLLEHTEFLERYIESV

SEQ ID NO: 3393654 - protein, 23 aa, Plasmodium falciparum
SLQHNIYNKLNKRKIMINQINHE

SEQ ID NO: 3393655 - protein, 25 aa, Plasmodium falciparum
SLQLSTLFQFLYFSPNHSFLKNHSD

SEQ ID NO: 3393656 - protein, 20 aa, Plasmodium falciparum
SLQYFNFFCKYEKNSNIRDL

SEQ ID NO: 3393657 - protein, 24 aa, Plasmodium falciparum
SLRKGIFRHIIILFDMSSSMKERD

SEQ ID NO: 3393658 - protein, 18 aa, Plasmodium falciparum
SLRRRYGKFIATVVFKNG

SEQ ID NO: 3393659 - protein, 24 aa, Plasmodium falciparum
SLRTKHYLDKIYFLCLKKIHEFNY

SEQ ID NO: 3393660 - protein, 23 aa, Plasmodium falciparum
SLSFMIYGLLKLNLKDKKIYQIL

SEQ ID NO: 3393661 - protein, 25 aa, Plasmodium falciparum
SLSHVPHFVYTLLDNFQGCIKNLSF

SEQ ID NO: 3393662 - protein, 17 aa, Plasmodium falciparum
SLSIATHLFFQSRGFLY

SEQ ID NO: 3393663 - protein, 17 aa, Plasmodium falciparum
SLSQEYPLRIPIIGDDG

SEQ ID NO: 3393664 - protein, 24 aa, Plasmodium falciparum
SLSSPPHPPHLPHPPQLLNNTVNK

SEQ ID NO: 3393665 - protein, 23 aa, Plasmodium falciparum
SLTETYIINKIKTWIKNEGIYLD

SEQ ID NO: 3393666 - protein, 24 aa, Plasmodium falciparum
SLTIDGIFFVIDPGFCKIKKYDSK

SEQ ID NO: 3393667 - protein, 17 aa, Plasmodium falciparum
SLTRPKLVKIFQQVAEG

SEQ ID NO: 3393668 - protein, 31 aa, Plasmodium falciparum
SLVDMIEYFCNFLIKYFYNDINMDSINIKES

SEQ ID NO: 3393669 - protein, 18 aa, Plasmodium falciparum
SLVIWRIKKFLSSSEHNI

SEQ ID NO: 3393670 - protein, 23 aa, Plasmodium falciparum
SLVNYKTIFSSPIYMNICINHFV

SEQ ID NO: 3393671 - protein, 23 aa, Plasmodium falciparum
SLVYLCTLIDILKEHNKYYGIRG

SEQ ID NO: 3393672 - protein, 18 aa, Plasmodium falciparum
SLWIGNIPFDITENELYE

SEQ ID NO: 3393673 - protein, 23 aa, Plasmodium falciparum
SLWNTQIHLLNEKIKNMKTKMEN

SEQ ID NO: 3393674 - protein, 17 aa, Plasmodium falciparum
SLYDLYVQLKEKLNEWK

SEQ ID NO: 3393675 - protein, 24 aa, Plasmodium falciparum
SLYIGKYVIIGCGTLICPCFTNKI

SEQ ID NO: 3393676 - protein, 21 aa, Plasmodium falciparum
SLYIGVFNTKVITLDLDKAMY

SEQ ID NO: 3393677 - protein, 21 aa, Plasmodium falciparum
SLYIKKIYYENIHLLFPQIKI

SEQ ID NO: 3393678 - protein, 30 aa, Plasmodium falciparum
SLYINITNPLLPWKILCNDILNTWKLSHMR

SEQ ID NO: 3393679 - protein, 32 aa, Plasmodium falciparum
SLYNNFFIVEKKIPFINFLQEKEKIMLSQFND

SEQ ID NO: 3393680 - protein, 20 aa, Plasmodium falciparum
SLYSNYIGTYVWLSDPSIYN

SEQ ID NO: 3393681 - protein, 18 aa, Plasmodium falciparum
SLYYLIIEYIISNNKNLK

SEQ ID NO: 3393682 - protein, 30 aa, Plasmodium falciparum
SMAHSCVGTPYYWSPELLLHETKSYDDKSD

SEQ ID NO: 3393683 - protein, 35 aa, Plasmodium falciparum
SMCYHICVNLFFNDLLHYFHLFYSCFFSFDHFLQK

SEQ ID NO: 3393684 - protein, 28 aa, Plasmodium falciparum
SMDELNMGELFLNIYLCERVATQKIVPL

SEQ ID NO: 3393685 - protein, 30 aa, Plasmodium falciparum
SMINENFKNKGFLKYKNDNLIISDANYVSN

SEQ ID NO: 3393686 - protein, 21 aa, Plasmodium falciparum
SMIRNDFISIFLNSLYLGDIE

SEQ ID NO: 3393687 - protein, 23 aa, Plasmodium falciparum
SMKDRMFLKNLYMKQNRLRDKRG

SEQ ID NO: 3393688 - protein, 23 aa, Plasmodium falciparum
SMKKKYLFRIFKSTKFFQCTEMD

SEQ ID NO: 3393689 - protein, 17 aa, Plasmodium falciparum
SMKSKITKISSLLKRNE

SEQ ID NO: 3393690 - protein, 30 aa, Plasmodium falciparum
SMKYKYFLVPFSKFISYIFPKCRINQNFNF

SEQ ID NO: 3393691 - protein, 28 aa, Plasmodium falciparum
SMLNKCNFVIFTSFLLSKQLQYYVDQTD

SEQ ID NO: 3393692 - protein, 21 aa, Plasmodium falciparum
SMMQVQYHCVFFSAIRNDIPV

SEQ ID NO: 3393693 - protein, 30 aa, Plasmodium falciparum
SMNPNSIRNMFILLRNKLSNLNVKNTMNSH

SEQ ID NO: 3393694 - protein, 19 aa, Plasmodium falciparum
SMNSLINFLWNILENKIND

SEQ ID NO: 3393695 - protein, 25 aa, Plasmodium falciparum
SMNSNIFPLNLYPEDMYSIYFPIVN

SEQ ID NO: 3393696 - protein, 21 aa, Plasmodium falciparum
SMQNYYFPSKYLHLDFNLKEY

SEQ ID NO: 3393697 - protein, 25 aa, Plasmodium falciparum
SMQTTNIHYLINRVIFKECEYENLV

SEQ ID NO: 3393698 - protein, 23 aa, Plasmodium falciparum
SMSLYQFIIAIRDSEQYGNLTNE

SEQ ID NO: 3393699 - protein, 30 aa, Plasmodium falciparum
SMYDIKVPIKKYFQGLKKINNLLSKGNNND

SEQ ID NO: 3393700 - protein, 18 aa, Plasmodium falciparum
SMYLFNNYVDRSKTPIVR

SEQ ID NO: 3393701 - protein, 21 aa, Plasmodium falciparum
SNAKLCIRYNMGNNGLNLLLN

SEQ ID NO: 3393702 - protein, 19 aa, Plasmodium falciparum
SNALFAYNSAFQSIPIKSS

SEQ ID NO: 3393703 - protein, 27 aa, Plasmodium falciparum
SNAQHKVIFKNYAPIIFKNIRNFYGIK

SEQ ID NO: 3393704 - protein, 23 aa, Plasmodium falciparum
SNASFMKNFNNYDIPEQFINYSS

SEQ ID NO: 3393705 - protein, 26 aa, Plasmodium falciparum
SNCMLLNGINFYGNNLRIGRPKTFPI

SEQ ID NO: 3393706 - protein, 28 aa, Plasmodium falciparum
SNDEDDVLRLLSYNSLFNKKTNQDLTYQ

SEQ ID NO: 3393707 - protein, 24 aa, Plasmodium falciparum
SNDIMLNIGDCFFKFDLDYIEEHL

SEQ ID NO: 3393708 - protein, 23 aa, Plasmodium falciparum
SNDKYFKLKKKKKKKYIYIYTHM

SEQ ID NO: 3393709 - protein, 26 aa, Plasmodium falciparum
SNDLFPTIDVLYLPYNKRTMISSKNY

SEQ ID NO: 3393710 - protein, 18 aa, Plasmodium falciparum
SNDLLNFKKRKNSFLLMK

SEQ ID NO: 3393711 - protein, 32 aa, Plasmodium falciparum
SNDNIFRISDYIRDNLTSYRQILNDHELDIHE

SEQ ID NO: 3393712 - protein, 28 aa, Plasmodium falciparum
SNDSYRIDRIYLSPDNYFSYSSNRNRNN

SEQ ID NO: 3393713 - protein, 24 aa, Plasmodium falciparum
SNDYIIYENFLQQNGLLCIKNILH

SEQ ID NO: 3393714 - protein, 29 aa, Plasmodium falciparum
SNENIPFILMQIICWVIGEYSHLCDIENY

SEQ ID NO: 3393715 - protein, 22 aa, Plasmodium falciparum
SNENLINIFKKMLPHAKVNIVG

SEQ ID NO: 3393716 - protein, 23 aa, Plasmodium falciparum
SNEPVWWLPIINEYRATLNSKYA

SEQ ID NO: 3393717 - protein, 22 aa, Plasmodium falciparum
SNEQIRILVRLINSNSLCNNTN

SEQ ID NO: 3393718 - protein, 28 aa, Plasmodium falciparum
SNEQLKRFVYRMYLNFTKEPINVFNGDN

SEQ ID NO: 3393719 - protein, 25 aa, Plasmodium falciparum
SNEYYNLSLFYDPWNNNTKDNHFFG

SEQ ID NO: 3393720 - protein, 24 aa, Plasmodium falciparum
SNFKSVIPPPLPMNTQMNNSTSSI

SEQ ID NO: 3393721 - protein, 29 aa, Plasmodium falciparum
SNFLAKGNYPWIYLSLRLKYDIVDINVHP

SEQ ID NO: 3393722 - protein, 27 aa, Plasmodium falciparum
SNFLNTPNIVVPKYSNIRPITQKDSLS

SEQ ID NO: 3393723 - protein, 18 aa, Plasmodium falciparum
SNFMNVLQNVGAGNGYIP

SEQ ID NO: 3393724 - protein, 23 aa, Plasmodium falciparum
SNFVCIHVLINSKNIDKCLKPYL

SEQ ID NO: 3393725 - protein, 28 aa, Plasmodium falciparum
SNGAIYIQLLDILFPNKSVLHKAKWNAK

SEQ ID NO: 3393726 - protein, 34 aa, Plasmodium falciparum
SNGKRYFMEIRKIYFLMKKFHKEGYFPSSNKDVL

SEQ ID NO: 3393727 - protein, 24 aa, Plasmodium falciparum
SNGTLLPRDGFLLQSAYYILNYCL

SEQ ID NO: 3393728 - protein, 28 aa, Plasmodium falciparum
SNHGDKSMWFNYNFDEHTFKEWVQKHID

SEQ ID NO: 3393729 - protein, 27 aa, Plasmodium falciparum
SNHTSTFLNYDLYRTDSIYIGPNSCEN

SEQ ID NO: 3393730 - protein, 20 aa, Plasmodium falciparum
SNICICKYIDKYDMKNLIDE

SEQ ID NO: 3393731 - protein, 28 aa, Plasmodium falciparum
SNIDIPMDAKNYIIKRMTSSTKLKSNLT

SEQ ID NO: 3393732 - protein, 25 aa, Plasmodium falciparum
SNIDNYMQSIFNNQIKYLDNLISQI

SEQ ID NO: 3393733 - protein, 36 aa, Plasmodium falciparum
SNIDYKKLLNLKKIMNSFLLFLHMGRNKFQSDINSI

SEQ ID NO: 3393734 - protein, 17 aa, Plasmodium falciparum
SNIFMPLGYLKINEAHL

SEQ ID NO: 3393735 - protein, 42 aa, Plasmodium falciparum
SNIIRTFGPFNNVKNVIIHIPLFLRYFIQTHVSSTKARTNRC

SEQ ID NO: 3393736 - protein, 26 aa, Plasmodium falciparum
SNIKTVYYIWNQFFDNLRMKYENGEY

SEQ ID NO: 3393737 - protein, 20 aa, Plasmodium falciparum
SNILLCGFPIFLRKSYYNNK

SEQ ID NO: 3393738 - protein, 27 aa, Plasmodium falciparum
SNIMLSFFIFFKFKESFIRDYLITFIQ

SEQ ID NO: 3393739 - protein, 26 aa, Plasmodium falciparum
SNINELKLPPIMPPILPNLNNSQNII

SEQ ID NO: 3393740 - protein, 26 aa, Plasmodium falciparum
SNINNNIPLNVKFLNKNAVNANYNVS

SEQ ID NO: 3393741 - protein, 19 aa, Plasmodium falciparum
SNIRLIFKGPLMLVAGMIP

SEQ ID NO: 3393742 - protein, 23 aa, Plasmodium falciparum
SNIWRIKFLYKNNSVDNLLVAAC

SEQ ID NO: 3393743 - protein, 25 aa, Plasmodium falciparum
SNKALYTFSLPEFNPFGYLKDRDSA

SEQ ID NO: 3393744 - protein, 26 aa, Plasmodium falciparum
SNKEPNFLYVCDVLFPLEQVPQEKCI

SEQ ID NO: 3393745 - protein, 19 aa, Plasmodium falciparum
SNKGILKICDFGMARKFGH

SEQ ID NO: 3393746 - protein, 23 aa, Plasmodium falciparum
SNKIRTHISIPLKKNTNHMNHKK

SEQ ID NO: 3393747 - protein, 23 aa, Plasmodium falciparum
SNKNINLFLLNYEKYKHKKEQYH

SEQ ID NO: 3393748 - protein, 23 aa, Plasmodium falciparum
SNKNIYYMVIPLSKHSIFTYNVD

SEQ ID NO: 3393749 - protein, 21 aa, Plasmodium falciparum
SNKNSVLKDILYNMDHKMTNN

SEQ ID NO: 3393750 - protein, 28 aa, Plasmodium falciparum
SNKRNETYCIFPKKKEIYFNKVNALTED

SEQ ID NO: 3393751 - protein, 18 aa, Plasmodium falciparum
SNKTVISVFPYEKFGRHE

SEQ ID NO: 3393752 - protein, 24 aa, Plasmodium falciparum
SNKYIYIYCFHNIYKQKLESILHI

SEQ ID NO: 3393753 - protein, 18 aa, Plasmodium falciparum
SNLHNFIVNSNNGDILFF

SEQ ID NO: 3393754 - protein, 18 aa, Plasmodium falciparum
SNLIGQFGVGFYSSFLVS

SEQ ID NO: 3393755 - protein, 23 aa, Plasmodium falciparum
SNLLIYLKHFYQHFKKENVNKNI

SEQ ID NO: 3393756 - protein, 26 aa, Plasmodium falciparum
SNLPQQPFPNIFFKKARNFNSFQCVT

SEQ ID NO: 3393757 - protein, 22 aa, Plasmodium falciparum
SNLSREVWWKKHGPKIWEGMLC

SEQ ID NO: 3393758 - protein, 31 aa, Plasmodium falciparum
SNLTPDHMITLWKTFSIYVEKYYHILKERAS

SEQ ID NO: 3393759 - protein, 25 aa, Plasmodium falciparum
SNLTPNMNNIPPPTAPPLVVNNSHG

SEQ ID NO: 3393760 - protein, 17 aa, Plasmodium falciparum
SNLYKLYHKGMGISPEY

SEQ ID NO: 3393761 - protein, 18 aa, Plasmodium falciparum
SNMLPYDNMLINNQFRVK

SEQ ID NO: 3393762 - protein, 19 aa, Plasmodium falciparum
SNMTLDNNLLLTKKNKKIN

SEQ ID NO: 3393763 - protein, 31 aa, Plasmodium falciparum
SNMTNRVITLWYRPPELLLGSENYMASVDMW

SEQ ID NO: 3393764 - protein, 25 aa, Plasmodium falciparum
SNNDNIILFTYMLDKYLYYYEAQNI

SEQ ID NO: 3393765 - protein, 22 aa, Plasmodium falciparum
SNNEYLPLILITAGTNVADHEI

SEQ ID NO: 3393766 - protein, 25 aa, Plasmodium falciparum
SNNFHSFIVEYKKLYNIKIKRQKIK

SEQ ID NO: 3393767 - protein, 17 aa, Plasmodium falciparum
SNNFINCNNALLINEYN

SEQ ID NO: 3393768 - protein, 21 aa, Plasmodium falciparum
SNNFLPINTFHYNNNLNHNIL

SEQ ID NO: 3393769 - protein, 24 aa, Plasmodium falciparum
SNNKLYEHILNEDIFYKTNNTLTS

SEQ ID NO: 3393770 - protein, 30 aa, Plasmodium falciparum
SNNKSYHNLAKWLYELYINTKPPSDVFCGE

SEQ ID NO: 3393771 - protein, 32 aa, Plasmodium falciparum
SNNMKHPCHAQWFLFWVFASYLNEKFSDTEKE

SEQ ID NO: 3393772 - protein, 21 aa, Plasmodium falciparum
SNNNIFFSYNPFHKFNEDSQN

SEQ ID NO: 3393773 - protein, 25 aa, Plasmodium falciparum
SNNNKLLHLSSFNSSTPTNGAIVID

SEQ ID NO: 3393774 - protein, 29 aa, Plasmodium falciparum
SNNNLVRNYYDGLYPFLNNYKEEECSMNY

SEQ ID NO: 3393775 - protein, 31 aa, Plasmodium falciparum
SNNPILRNTFSQSPLMQPVLENPNLLREFMR

SEQ ID NO: 3393776 - protein, 29 aa, Plasmodium falciparum
SNNQFFINIQLFFKYIFSLLSNIIQMKEK

SEQ ID NO: 3393777 - protein, 24 aa, Plasmodium falciparum
SNNVCTLNYIKKKTSLDNDHSRII

SEQ ID NO: 3393778 - protein, 30 aa, Plasmodium falciparum
SNNYSDNMLLRSSIKNGPKYSVHYPSSSNN

SEQ ID NO: 3393779 - protein, 23 aa, Plasmodium falciparum
SNPLEFLRILDEKKFLPLESNYP

SEQ ID NO: 3393780 - protein, 26 aa, Plasmodium falciparum
SNPLITNFFSWFLSSMIKYLRVKEKF

SEQ ID NO: 3393781 - protein, 25 aa, Plasmodium falciparum
SNPYNLYPNFNLKYPMNMDMFNNNN

SEQ ID NO: 3393782 - protein, 19 aa, Plasmodium falciparum
SNQLPLLSFVTFNNNITHK

SEQ ID NO: 3393783 - protein, 38 aa, Plasmodium falciparum
SNQMVSADTPVLLAKACELFIMELTSNAWKYTEEGKRR

SEQ ID NO: 3393784 - protein, 17 aa, Plasmodium falciparum
SNQRYYPEFVTGKKIED

SEQ ID NO: 3393785 - protein, 17 aa, Plasmodium falciparum
SNQYLFLAQGSARIYFI

SEQ ID NO: 3393786 - protein, 28 aa, Plasmodium falciparum
SNQYNIKKLWIIVKDLPEKYYALHENDI

SEQ ID NO: 3393787 - protein, 25 aa, Plasmodium falciparum
SNRKTIKLELYLSKLITINVRTLQS

SEQ ID NO: 3393788 - protein, 26 aa, Plasmodium falciparum
SNRSALHYAVYRNNCDYVKFLIYEEK

SEQ ID NO: 3393789 - protein, 42 aa, Plasmodium falciparum
SNRYTTYTKLKHRILTKLGYNVIHISYIDWRKLRNKSEREEF

SEQ ID NO: 3393790 - protein, 31 aa, Plasmodium falciparum
SNSDLLYKIIYQLFNIMVHMDFEVGIFILQF

SEQ ID NO: 3393791 - protein, 24 aa, Plasmodium falciparum
SNSFFSNLSSRLLNKEKKEGGGGN

SEQ ID NO: 3393792 - protein, 20 aa, Plasmodium falciparum
SNSKYPWNDLSNASIECLEN

SEQ ID NO: 3393793 - protein, 31 aa, Plasmodium falciparum
SNSLYKTVWLENFGSIYFFGSSIIRLTKKDF

SEQ ID NO: 3393794 - protein, 24 aa, Plasmodium falciparum
SNSSGLYYSFNVKGKTSSNIYDYF

SEQ ID NO: 3393795 - protein, 25 aa, Plasmodium falciparum
SNTEFRRICLKWKAKKIKRRSRLKK

SEQ ID NO: 3393796 - protein, 29 aa, Plasmodium falciparum
SNTEQYQIFKILEGILYIGNILFNNDETK

SEQ ID NO: 3393797 - protein, 19 aa, Plasmodium falciparum
SNTGIILTPWKLFKENKWN

SEQ ID NO: 3393798 - protein, 20 aa, Plasmodium falciparum
SNTLLHFKEKYTYPTLSTNE

SEQ ID NO: 3393799 - protein, 27 aa, Plasmodium falciparum
SNTQLLYLAYAYYSSILRFYKTKYTHL

SEQ ID NO: 3393800 - protein, 25 aa, Plasmodium falciparum
SNTYKLRRYETYIGYLRIRTHNDRN

SEQ ID NO: 3393801 - protein, 20 aa, Plasmodium falciparum
SNTYVLRFLNMKMKYRSNFL

SEQ ID NO: 3393802 - protein, 25 aa, Plasmodium falciparum
SNVCNNIYYFLNDYSIFEEFKNLDI

SEQ ID NO: 3393803 - protein, 41 aa, Plasmodium falciparum
SNVEGMINNFLYKKKLLKENVFNLLLKLSKSYEVKYSEVIN

SEQ ID NO: 3393804 - protein, 28 aa, Plasmodium falciparum
SNVFLPQFEEDILLKLQKTINMKLNEKK

SEQ ID NO: 3393805 - protein, 17 aa, Plasmodium falciparum
SNVIKDIYTYWKNKRKK

SEQ ID NO: 3393806 - protein, 36 aa, Plasmodium falciparum
SNVKKEVKLFIKKIPIYIWVKQFNLMNEYDGEYVTD

SEQ ID NO: 3393807 - protein, 23 aa, Plasmodium falciparum
SNVLNVTLSDKLKILEQMEKEYY

SEQ ID NO: 3393808 - protein, 21 aa, Plasmodium falciparum
SNVYFKFLTLEQRSFFTTLMD

SEQ ID NO: 3393809 - protein, 19 aa, Plasmodium falciparum
SNWPVFTNFICSFSNAWLE

SEQ ID NO: 3393810 - protein, 32 aa, Plasmodium falciparum
SNYIHNIKKLLYQYFLFFKNIFDNTCLTYLLE

SEQ ID NO: 3393811 - protein, 22 aa, Plasmodium falciparum
SNYLINSLVLFFKKYLKRYKEE

SEQ ID NO: 3393812 - protein, 30 aa, Plasmodium falciparum
SNYNFPYVINRMLYLALPPHIFVSTLKNYK

SEQ ID NO: 3393813 - protein, 25 aa, Plasmodium falciparum
SNYNPYFMNNYMNSKNHPLYLNSNN

SEQ ID NO: 3393814 - protein, 26 aa, Plasmodium falciparum
SNYYGPDIIHLFNQTKLNLSFYQREI

SEQ ID NO: 3393815 - protein, 32 aa, Plasmodium falciparum
SNYYSYLYCSVLAKYIWNMTFKDNLFNTEKAD

SEQ ID NO: 3393816 - protein, 18 aa, Plasmodium falciparum
SPCYIFPDLFTEFHNSFK

SEQ ID NO: 3393817 - protein, 40 aa, Plasmodium falciparum
SPDDIKFLSHESLFLKKKLQLDEPLWKPSLKLNNLNQYIQ

SEQ ID NO: 3393818 - protein, 28 aa, Plasmodium falciparum
SPDLLEHHYFKKLLKHIGFLYNQNVDEW

SEQ ID NO: 3393819 - protein, 19 aa, Plasmodium falciparum
SPEFIVIKYVIQNNKCTLE

SEQ ID NO: 3393820 - protein, 23 aa, Plasmodium falciparum
SPEKLTYWSLYKYLSEFLTDPRV

SEQ ID NO: 3393821 - protein, 18 aa, Plasmodium falciparum
SPGYKFNHWELRGIPIRI

SEQ ID NO: 3393822 - protein, 25 aa, Plasmodium falciparum
SPHAYLYGHSIVKFGNKLYMFGGSN

SEQ ID NO: 3393823 - protein, 22 aa, Plasmodium falciparum
SPIDLVMDWYSANRSRQLFEKM

SEQ ID NO: 3393824 - protein, 20 aa, Plasmodium falciparum
SPIQIEYYKNILTKNYEQLA

SEQ ID NO: 3393825 - protein, 24 aa, Plasmodium falciparum
SPKYKTLIEMVLNPSSKTYDMKDT

SEQ ID NO: 3393826 - protein, 22 aa, Plasmodium falciparum
SPKYKTLIEVVLEPSKRDTPSS

SEQ ID NO: 3393827 - protein, 18 aa, Plasmodium falciparum
SPLDIYMRLYFKSNNIKN

SEQ ID NO: 3393828 - protein, 17 aa, Plasmodium falciparum
SPLSIKHFENCNHFAKC

SEQ ID NO: 3393829 - protein, 23 aa, Plasmodium falciparum
SPNHIEVLNLLFLMNGDNQIKKD

SEQ ID NO: 3393830 - protein, 27 aa, Plasmodium falciparum
SPNIPYTYLFICDGSNYLCINDNSLNN

SEQ ID NO: 3393831 - protein, 25 aa, Plasmodium falciparum
SPNYINGVVFFFKKNEYINSEMFFN

SEQ ID NO: 3393832 - protein, 47 aa, Plasmodium falciparum
SPRTEKLIEIISPILDYYGYNREDVYNFISLYKFDIEKIQLELCNIM

SEQ ID NO: 3393833 - protein, 26 aa, Plasmodium falciparum
SPTAYAIYGNIFYAAPEVLKGEGFFK

SEQ ID NO: 3393834 - protein, 24 aa, Plasmodium falciparum
SPYEYLKYLFSKHNKLNIFHHDNK

SEQ ID NO: 3393835 - protein, 26 aa, Plasmodium falciparum
SPYNEKKYRLIGDFSRYMSVTINEKK

SEQ ID NO: 3393836 - protein, 36 aa, Plasmodium falciparum
SQCTNVTYNVRRMWHPLFNRPLGDIGRKLILKEIRE

SEQ ID NO: 3393837 - protein, 31 aa, Plasmodium falciparum
SQDFIFFMDIFNHYLFKYIYNISFSHVFKNL

SEQ ID NO: 3393838 - protein, 26 aa, Plasmodium falciparum
SQDNNAFYFYKMIPFEKLYTKDTMDK

SEQ ID NO: 3393839 - protein, 26 aa, Plasmodium falciparum
SQEFILRKKFIMPHFIYNCVDCNYNT

SEQ ID NO: 3393840 - protein, 26 aa, Plasmodium falciparum
SQEKHQYMFALTFNKKVFNDRKHVVF

SEQ ID NO: 3393841 - protein, 18 aa, Plasmodium falciparum
SQEKKKRIPKKKKKKRNL

SEQ ID NO: 3393842 - protein, 19 aa, Plasmodium falciparum
SQEQYYKRITRKSKAKVMI

SEQ ID NO: 3393843 - protein, 23 aa, Plasmodium falciparum
SQEVLKLKIFFLNIIKNMKNKKR

SEQ ID NO: 3393844 - protein, 30 aa, Plasmodium falciparum
SQGFRKVYQISAFPGIFRDAMGIAYDLRDK

SEQ ID NO: 3393845 - protein, 26 aa, Plasmodium falciparum
SQGNEFSYFMLLGSNFILNYYNEKYS

SEQ ID NO: 3393846 - protein, 24 aa, Plasmodium falciparum
SQGQSETLFLIKKQFFKTKMCPFQ

SEQ ID NO: 3393847 - protein, 28 aa, Plasmodium falciparum
SQHFICPLLYNTYSVPALVILFELLNDK

SEQ ID NO: 3393848 - protein, 22 aa, Plasmodium falciparum
SQHLIYGIPIFIYTTIHYETNL

SEQ ID NO: 3393849 - protein, 33 aa, Plasmodium falciparum
SQICNLCIIKRKNLYLKYKKFKKHNLRIREKHF

SEQ ID NO: 3393850 - protein, 20 aa, Plasmodium falciparum
SQIINLIKKLDILKRINIQT

SEQ ID NO: 3393851 - protein, 29 aa, Plasmodium falciparum
SQKKKNIFLMRCLKFLKSMKNILQLLCNE

SEQ ID NO: 3393852 - protein, 17 aa, Plasmodium falciparum
SQKLAQAAILFIGSKLT

SEQ ID NO: 3393853 - protein, 17 aa, Plasmodium falciparum
SQLILSSLKVCCSVLKV

SEQ ID NO: 3393854 - protein, 34 aa, Plasmodium falciparum
SQLPKNLKIIVIYKNLMKEIFYFKEITPIVDELE

SEQ ID NO: 3393855 - protein, 17 aa, Plasmodium falciparum
SQMFYTFKNEYFSKYIY

SEQ ID NO: 3393856 - protein, 25 aa, Plasmodium falciparum
SQMPILTFKLFLYSAIVVNNYNSFV

SEQ ID NO: 3393857 - protein, 24 aa, Plasmodium falciparum
SQNHPIFIHLYKLASDRNYRQKQE

SEQ ID NO: 3393858 - protein, 25 aa, Plasmodium falciparum
SQNKHFHMYVQLANINHFMKNHFFE

SEQ ID NO: 3393859 - protein, 20 aa, Plasmodium falciparum
SQPKLPITLDLPPQNIILKN

SEQ ID NO: 3393860 - protein, 25 aa, Plasmodium falciparum
SQQKEKFIKGLKNIKQAYIKLKNEN

SEQ ID NO: 3393861 - protein, 17 aa, Plasmodium falciparum
SQRPLDVRFASYKYNNS

SEQ ID NO: 3393862 - protein, 19 aa, Plasmodium falciparum
SQRWFGEHKINGVKCAQSF

SEQ ID NO: 3393863 - protein, 36 aa, Plasmodium falciparum
SQSDYLNIKKSKLINYLNFFMRVCCSKSSYIKFVNH

SEQ ID NO: 3393864 - protein, 23 aa, Plasmodium falciparum
SQVRLQCAILIRNIFRVYIKSTH

SEQ ID NO: 3393865 - protein, 20 aa, Plasmodium falciparum
SQYNDYYYKLLKSLYDDIYN

SEQ ID NO: 3393866 - protein, 23 aa, Plasmodium falciparum
SRANNFIYPVASSFIETIPKDDW

SEQ ID NO: 3393867 - protein, 23 aa, Plasmodium falciparum
SRCAIIRYFKLSDDQVLKRILKI

SEQ ID NO: 3393868 - protein, 23 aa, Plasmodium falciparum
SRDNVFEFWDWVGGRFSVTSSVG

SEQ ID NO: 3393869 - protein, 21 aa, Plasmodium falciparum
SREEKHIQALRNYKLELIQEL

SEQ ID NO: 3393870 - protein, 19 aa, Plasmodium falciparum
SREENLLQYLIIYGNLAVY

SEQ ID NO: 3393871 - protein, 26 aa, Plasmodium falciparum
SRELERINNIILKYSKNIETCNKNKK

SEQ ID NO: 3393872 - protein, 25 aa, Plasmodium falciparum
SRFCPQYLITYLNDIIPFLIAHITH

SEQ ID NO: 3393873 - protein, 36 aa, Plasmodium falciparum
SRGPVCYSALYRDNKYVYRHIILSDNVRQYAENKVR

SEQ ID NO: 3393874 - protein, 26 aa, Plasmodium falciparum
SRGSSFLPFNYCCISLRPFSEPYCDE

SEQ ID NO: 3393875 - protein, 22 aa, Plasmodium falciparum
SRIELIDIFGFPNEFDVMNKIL

SEQ ID NO: 3393876 - protein, 17 aa, Plasmodium falciparum
SRIKINIHKQFLHVTDF

SEQ ID NO: 3393877 - protein, 24 aa, Plasmodium falciparum
SRISTFFKWLYNCLKRGARAVFQF

SEQ ID NO: 3393878 - protein, 23 aa, Plasmodium falciparum
SRIYPNYIIKQLSIKHVKGMILY

SEQ ID NO: 3393879 - protein, 21 aa, Plasmodium falciparum
SRKDNIDICNKINLPRVYDNI

SEQ ID NO: 3393880 - protein, 17 aa, Plasmodium falciparum
SRKFGIDTYVKESAKIT

SEQ ID NO: 3393881 - protein, 21 aa, Plasmodium falciparum
SRKFMWICILCMCNYDDLPSL

SEQ ID NO: 3393882 - protein, 18 aa, Plasmodium falciparum
SRKLFCNSDKLFYDNFRN

SEQ ID NO: 3393883 - protein, 23 aa, Plasmodium falciparum
SRKWNEKILLHKIKLIIFDEIHL

SEQ ID NO: 3393884 - protein, 18 aa, Plasmodium falciparum
SRLFLNVLNSYNFIESCM

SEQ ID NO: 3393885 - protein, 27 aa, Plasmodium falciparum
SRLPKLQGMFFDKRRNYWTVSVCGFRK

SEQ ID NO: 3393886 - protein, 24 aa, Plasmodium falciparum
SRLSTFICIGVDNAFFKNMFSSVH

SEQ ID NO: 3393887 - protein, 25 aa, Plasmodium falciparum
SRNCCLILLFEYFINKLEHNINILN

SEQ ID NO: 3393888 - protein, 30 aa, Plasmodium falciparum
SRNINLVFEKYFFPMIQLNNIMKIPTTFSN

SEQ ID NO: 3393889 - protein, 17 aa, Plasmodium falciparum
SRPIAKIGDFGLSKNIG

SEQ ID NO: 3393890 - protein, 17 aa, Plasmodium falciparum
SRRRDSSRRRDRYSRRY

SEQ ID NO: 3393891 - protein, 30 aa, Plasmodium falciparum
SRSCLKNDYELLFYMMKNNFKGKINCCSVK

SEQ ID NO: 3393892 - protein, 24 aa, Plasmodium falciparum
SRSHSIFTITLIIKDINNVGESIT

SEQ ID NO: 3393893 - protein, 17 aa, Plasmodium falciparum
SRSILFSHLNDSFLLVT

SEQ ID NO: 3393894 - protein, 31 aa, Plasmodium falciparum
SRSLKNFYVLSLLNYFKLKIYNKIYVPTLGV

SEQ ID NO: 3393895 - protein, 23 aa, Plasmodium falciparum
SRSLSDISLNLTKYTLESEKILC

SEQ ID NO: 3393896 - protein, 22 aa, Plasmodium falciparum
SRSSLGRKISFSSDESYFDSDI

SEQ ID NO: 3393897 - protein, 21 aa, Plasmodium falciparum
SRVFLSILNIFHPKLYEHIKN

SEQ ID NO: 3393898 - protein, 23 aa, Plasmodium falciparum
SRYDKYLKLKNESNLNFLKNKMM

SEQ ID NO: 3393899 - protein, 32 aa, Plasmodium falciparum
SRYHNPMMNMSYIIEFLFPNMEQFLKRHEKMI

SEQ ID NO: 3393900 - protein, 23 aa, Plasmodium falciparum
SSAIFRHELAFVLGQVLHLNSLK

SEQ ID NO: 3393901 - protein, 27 aa, Plasmodium falciparum
SSAVWKVCWSHPKYGSLLASCSFDKNV

SEQ ID NO: 3393902 - protein, 27 aa, Plasmodium falciparum
SSCLNVREYLKLKKLLHISNEIQDINQ

SEQ ID NO: 3393903 - protein, 44 aa, Plasmodium falciparum
SSDDLKYIAILFDDKKWLHLYKIWKLIPLTLKFKAINSRDVNIC

SEQ ID NO: 3393904 - protein, 27 aa, Plasmodium falciparum
SSDDQINYYFLYKDIKIPLPSYAIPQT

SEQ ID NO: 3393905 - protein, 27 aa, Plasmodium falciparum
SSDDSKLYDILFINKKYHIKHTTCNSN

SEQ ID NO: 3393906 - protein, 27 aa, Plasmodium falciparum
SSDHIFPIIDLFRILVLNKNCDFLYNN

SEQ ID NO: 3393907 - protein, 21 aa, Plasmodium falciparum
SSDLRLPYYLVRTKGIDHIFS

SEQ ID NO: 3393908 - protein, 22 aa, Plasmodium falciparum
SSDWLPYGQYLQSKKKGGEIYA

SEQ ID NO: 3393909 - protein, 46 aa, Plasmodium falciparum
SSEEHIFNFPIEWNIPNFKNNISTKLKPWIYKKITEYIGADEKDII

SEQ ID NO: 3393910 - protein, 24 aa, Plasmodium falciparum
SSEFSIYPQFMYHLRRSHFLQTFN

SEQ ID NO: 3393911 - protein, 20 aa, Plasmodium falciparum
SSEFWEKFNEQYPICVKKRS

SEQ ID NO: 3393912 - protein, 18 aa, Plasmodium falciparum
SSEHMKLQRYVKLLHFIV

SEQ ID NO: 3393913 - protein, 24 aa, Plasmodium falciparum
SSEKACIYIYKPLESDICIQTIDF

SEQ ID NO: 3393914 - protein, 42 aa, Plasmodium falciparum
SSENVEEVVDNLTSEKNKESLKKDKRKKKEKKNNDVDDINEE

SEQ ID NO: 3393915 - protein, 25 aa, Plasmodium falciparum
SSEPYVPVTLLKSFRDVYPKFKSVN

SEQ ID NO: 3393916 - protein, 20 aa, Plasmodium falciparum
SSFHIYNKRTLTSNSLIDSI

SEQ ID NO: 3393917 - protein, 17 aa, Plasmodium falciparum
SSFILFFENMRMTKKVF

SEQ ID NO: 3393918 - protein, 25 aa, Plasmodium falciparum
SSFINKNFFTNSIPFNIFGSNNNNN

SEQ ID NO: 3393919 - protein, 19 aa, Plasmodium falciparum
SSFLLLFLEPKEVVKIITG

SEQ ID NO: 3393920 - protein, 17 aa, Plasmodium falciparum
SSFLYFLENSSKIVERV

SEQ ID NO: 3393921 - protein, 51 aa, Plasmodium falciparum
SSFNDYRNIMYPYNYISCLSCFTRKHMKCGYPPYIFAKNTYCYRKDYSFKS

SEQ ID NO: 3393922 - protein, 21 aa, Plasmodium falciparum
SSFPIIIIKPDILNITPNCVS

SEQ ID NO: 3393923 - protein, 24 aa, Plasmodium falciparum
SSFPIKVDLYFLKGSKVMPLNTGE

SEQ ID NO: 3393924 - protein, 24 aa, Plasmodium falciparum
SSGVIMYTLLCGYPPFYGDTDNEV

SEQ ID NO: 3393925 - protein, 26 aa, Plasmodium falciparum
SSGYLNFPMNFLKLIRNIYINVMQKK

SEQ ID NO: 3393926 - protein, 29 aa, Plasmodium falciparum
SSHDNMHDTYLYYPNFKMFISENNNNNKN

SEQ ID NO: 3393927 - protein, 17 aa, Plasmodium falciparum
SSHFIFTTSLTPVNINT

SEQ ID NO: 3393928 - protein, 17 aa, Plasmodium falciparum
SSHLFRIMWSEFEWENK

SEQ ID NO: 3393929 - protein, 25 aa, Plasmodium falciparum
SSHTSKFYLYGLKKNIYTSGTTTDM

SEQ ID NO: 3393930 - protein, 33 aa, Plasmodium falciparum
SSHVCLKYKMYLDNLLEEILLNYSKGVKSVEFD

SEQ ID NO: 3393931 - protein, 33 aa, Plasmodium falciparum
SSIDLFINLIMYIYNQFLYYIAHFENIFVHTKQ

SEQ ID NO: 3393932 - protein, 21 aa, Plasmodium falciparum
SSIHGVSFKTLYRSVYNKGSV

SEQ ID NO: 3393933 - protein, 22 aa, Plasmodium falciparum
SSIIHTYNIPSFFLLDKDVRNH

SEQ ID NO: 3393934 - protein, 17 aa, Plasmodium falciparum
SSIIIRLALAESFSIKC

SEQ ID NO: 3393935 - protein, 24 aa, Plasmodium falciparum
SSIKLPILVLIIKSMFVILNDEEY

SEQ ID NO: 3393936 - protein, 25 aa, Plasmodium falciparum
SSIKVFEYFRFWMDAKKKKFDQIVK

SEQ ID NO: 3393937 - protein, 32 aa, Plasmodium falciparum
SSILYNNHPYSYNNYLFCIKNLYHNNNNNNNS

SEQ ID NO: 3393938 - protein, 24 aa, Plasmodium falciparum
SSIPKFMIGFIGFPNVGKSSIINC

SEQ ID NO: 3393939 - protein, 22 aa, Plasmodium falciparum
SSIYEKYYTLKPFISLVGNKSD

SEQ ID NO: 3393940 - protein, 20 aa, Plasmodium falciparum
SSKFFENNVFFWDDKNKNVD

SEQ ID NO: 3393941 - protein, 30 aa, Plasmodium falciparum
SSKFRDHILTIFKVIYTATFKYGSSAKYLR

SEQ ID NO: 3393942 - protein, 23 aa, Plasmodium falciparum
SSKGYFIKKFHGLLKKRKKNEYE

SEQ ID NO: 3393943 - protein, 29 aa, Plasmodium falciparum
SSKNTLFILRQMFTYKIYPSPKMVKKLYH

SEQ ID NO: 3393944 - protein, 33 aa, Plasmodium falciparum
SSKRTGIPLNERKYYRILAKQMKKIQGLTFDHN

SEQ ID NO: 3393945 - protein, 24 aa, Plasmodium falciparum
SSKRTYDNFIEKIKLHENKELTLD

SEQ ID NO: 3393946 - protein, 35 aa, Plasmodium falciparum
SSKYLSTLMIYNPSMLYFLFNEYIGILVCHDYKKG

SEQ ID NO: 3393947 - protein, 28 aa, Plasmodium falciparum
SSLHIYAQFIHELFKCPYIYNAIDVELG

SEQ ID NO: 3393948 - protein, 17 aa, Plasmodium falciparum
SSLLLNPQNVIDKEPYN

SEQ ID NO: 3393949 - protein, 25 aa, Plasmodium falciparum
SSLNDNNIFLFEKKNEIMKEPTRDR

SEQ ID NO: 3393950 - protein, 24 aa, Plasmodium falciparum
SSLNYSNIFPFNCLNTNKNAISLS

SEQ ID NO: 3393951 - protein, 25 aa, Plasmodium falciparum
SSLPKYDIYFYDFSNSVWTEIVINS

SEQ ID NO: 3393952 - protein, 23 aa, Plasmodium falciparum
SSLRAHQLLNCKKYIYFSIDANR

SEQ ID NO: 3393953 - protein, 19 aa, Plasmodium falciparum
SSLYPFYEIIIFTTAIKSY

SEQ ID NO: 3393954 - protein, 21 aa, Plasmodium falciparum
SSMTFLARQAFSKIFNQSPDD

SEQ ID NO: 3393955 - protein, 31 aa, Plasmodium falciparum
SSNDGPFINQGMMPGITNLRSSHFMSNSSAN

SEQ ID NO: 3393956 - protein, 52 aa, Plasmodium falciparum
SSNGNAYNISYMFIYQYYYVLHTKKEMMYNFYSEKAILLVSFNDESKIINTK

SEQ ID NO: 3393957 - protein, 37 aa, Plasmodium falciparum
SSNIYSFFEYLYEQDINFILPLCVTVNQINKYIQDEH

SEQ ID NO: 3393958 - protein, 30 aa, Plasmodium falciparum
SSNKKDYLLKMKTFIQNDIPHIIKKSVDIH

SEQ ID NO: 3393959 - protein, 23 aa, Plasmodium falciparum
SSNLIYFYPYTINDIQKIIHNLK

SEQ ID NO: 3393960 - protein, 22 aa, Plasmodium falciparum
SSNMLNDILCNKLGLINMTTEN

SEQ ID NO: 3393961 - protein, 25 aa, Plasmodium falciparum
SSNRKPFLFLLSLASDPTNMIDDFA

SEQ ID NO: 3393962 - protein, 24 aa, Plasmodium falciparum
SSNRWADMCEDCDAPLVDTYNDNN

SEQ ID NO: 3393963 - protein, 24 aa, Plasmodium falciparum
SSNRYKLLINLFKKYKLYYCKNEI

SEQ ID NO: 3393964 - protein, 27 aa, Plasmodium falciparum
SSNYDNNYLLYRKINRLNKTNTNKSKN

SEQ ID NO: 3393965 - protein, 27 aa, Plasmodium falciparum
SSNYPLHIYNPKFFSSLDLFNERSQEN

SEQ ID NO: 3393966 - protein, 35 aa, Plasmodium falciparum
SSQFNQIMRFLIKNLLFFNIYNKKIYYILSSYEKT

SEQ ID NO: 3393967 - protein, 24 aa, Plasmodium falciparum
SSQTMLPFSYIGLNLGQYDILNPP

SEQ ID NO: 3393968 - protein, 25 aa, Plasmodium falciparum
SSRNVRFFLRYLLPEYKEENKHLNF

SEQ ID NO: 3393969 - protein, 22 aa, Plasmodium falciparum
SSRQISEDIPSSVIKKLKDRIK

SEQ ID NO: 3393970 - protein, 22 aa, Plasmodium falciparum
SSRSHAILQIYVYNEILDDNMN

SEQ ID NO: 3393971 - protein, 19 aa, Plasmodium falciparum
SSRVIIYSKGASLVYNVDE

SEQ ID NO: 3393972 - protein, 24 aa, Plasmodium falciparum
SSSLANCLLIKYASYLIYCTEVHS

SEQ ID NO: 3393973 - protein, 19 aa, Plasmodium falciparum
SSSLFLYDIDNMKKILKNY

SEQ ID NO: 3393974 - protein, 28 aa, Plasmodium falciparum
SSSLNIINLFMFSIIFNSSKNNVSVQSF

SEQ ID NO: 3393975 - protein, 22 aa, Plasmodium falciparum
SSSLYKCKMLKISALGRMCKLV

SEQ ID NO: 3393976 - protein, 22 aa, Plasmodium falciparum
SSSPFFINKDLYNSFEDLNESS

SEQ ID NO: 3393977 - protein, 28 aa, Plasmodium falciparum
SSSVPCSTSLFNNTWNKSLSNSKKNIKG

SEQ ID NO: 3393978 - protein, 22 aa, Plasmodium falciparum
SSSYAFVHYYDLKDADYAIERR

SEQ ID NO: 3393979 - protein, 26 aa, Plasmodium falciparum
SSTKDLNYFFHLKLGFFVCYKNHNDK

SEQ ID NO: 3393980 - protein, 28 aa, Plasmodium falciparum
SSTVLNDRWFLLCGGYNLSWYQKSNLLD

SEQ ID NO: 3393981 - protein, 25 aa, Plasmodium falciparum
SSVSSKMYYLLKDKEKKKQEKSTED

SEQ ID NO: 3393982 - protein, 22 aa, Plasmodium falciparum
SSWETLWLSWKHVFKNSFDENN

SEQ ID NO: 3393983 - protein, 39 aa, Plasmodium falciparum
SSYFDDVLFFFVKCELLYWDPLYQFFMSKKKKKRILNYF

SEQ ID NO: 3393984 - protein, 25 aa, Plasmodium falciparum
SSYGIICLGISFDKKLLALGEKSVN

SEQ ID NO: 3393985 - protein, 53 aa, Plasmodium falciparum
SSYIDKETFLQFFPLPGLWGERLFLKFNFKNTGFIDFEEFIIGIAICCRGTKS

SEQ ID NO: 3393986 - protein, 17 aa, Plasmodium falciparum
SSYIFGGIYAQYTRKRT

SEQ ID NO: 3393987 - protein, 23 aa, Plasmodium falciparum
SSYLSYPIFSFDSNFVLSGGQDG

SEQ ID NO: 3393988 - protein, 22 aa, Plasmodium falciparum
SSYYYNNYPCYPQNSNINNLDT

SEQ ID NO: 3393989 - protein, 25 aa, Plasmodium falciparum
STAKSQLLHYVHKLSPRGIYTSGKG

SEQ ID NO: 3393990 - protein, 24 aa, Plasmodium falciparum
STCAYDYYIKFNSVLIPLVELEKE

SEQ ID NO: 3393991 - protein, 31 aa, Plasmodium falciparum
STDDKTCTVIFFYWRKDIFNIQPQDVNVTEI

SEQ ID NO: 3393992 - protein, 18 aa, Plasmodium falciparum
STDILFCLLKDVVRKRAD

SEQ ID NO: 3393993 - protein, 22 aa, Plasmodium falciparum
STEKWLIECSPNYYIFENSNIK

SEQ ID NO: 3393994 - protein, 34 aa, Plasmodium falciparum
STEQRIPFCIGKQKEMFLKFFKTNMINGNIIQNK

SEQ ID NO: 3393995 - protein, 30 aa, Plasmodium falciparum
STESGPLHLLKKFIPKFYGVTEILVESCSD

SEQ ID NO: 3393996 - protein, 35 aa, Plasmodium falciparum
STEYLNLYFKDLKDYLIRYNKFEELYNYCYNVLTN

SEQ ID NO: 3393997 - protein, 27 aa, Plasmodium falciparum
STFANFIHWIIAGNMKGYIFVWEVPSG

SEQ ID NO: 3393998 - protein, 31 aa, Plasmodium falciparum
STFLQIYCDNLWLLPYLLTICSFLNNISTLA

SEQ ID NO: 3393999 - protein, 28 aa, Plasmodium falciparum
STFLSIKKYIFYKFIYKCQNIINLFLEY

SEQ ID NO: 3394000 - protein, 25 aa, Plasmodium falciparum
STFQLPKLYIKQCYCVSCAIHSRFV

SEQ ID NO: 3394001 - protein, 33 aa, Plasmodium falciparum
STFTQEIWTHILIKALYKCFHIFHFKNYHMHII

SEQ ID NO: 3394002 - protein, 25 aa, Plasmodium falciparum
STGNLIFELLSYLLNIPLYNQDEIV

SEQ ID NO: 3394003 - protein, 24 aa, Plasmodium falciparum
STHKLNIYNLFNKSNKNKNNNANT

SEQ ID NO: 3394004 - protein, 20 aa, Plasmodium falciparum
STICYSFAKLKIRNISFFIL

SEQ ID NO: 3394005 - protein, 18 aa, Plasmodium falciparum
STIFFSLNGQIKKTSFMD

SEQ ID NO: 3394006 - protein, 26 aa, Plasmodium falciparum
STILKKCFTIIFYIDELIKNGVREIV

SEQ ID NO: 3394007 - protein, 34 aa, Plasmodium falciparum
STIMKGTKYNLLLNGYYSIKWKQNIEWKNYLNKI

SEQ ID NO: 3394008 - protein, 32 aa, Plasmodium falciparum
STIQKKLCFFFKSLNFHYVYDSSLGELITLNE

SEQ ID NO: 3394009 - protein, 33 aa, Plasmodium falciparum
STISKMKYHLNKHRCNLVYTCPGCSQTFVIYKD

SEQ ID NO: 3394010 - protein, 22 aa, Plasmodium falciparum
STIYFDYVLDLFYNGVIETFSL

SEQ ID NO: 3394011 - protein, 17 aa, Plasmodium falciparum
STIYTWVNNIDTNYMYN

SEQ ID NO: 3394012 - protein, 27 aa, Plasmodium falciparum
STKKIQLKWKSILARKQLRRLKMESKE

SEQ ID NO: 3394013 - protein, 27 aa, Plasmodium falciparum
STKKRPVPLLHYIYVYDSVYLVMDEKN

SEQ ID NO: 3394014 - protein, 19 aa, Plasmodium falciparum
STLAWGINLPAYLVIIKGN

SEQ ID NO: 3394015 - protein, 24 aa, Plasmodium falciparum
STLHLVLRLRGGAIEPSLAQLAQK

SEQ ID NO: 3394016 - protein, 35 aa, Plasmodium falciparum
STLPYKYKNYDLPKKGFSLIWSLKKSRRNSPLSTK

SEQ ID NO: 3394017 - protein, 25 aa, Plasmodium falciparum
STNDIIYFMNKYVFTKEKHPIYNNT

SEQ ID NO: 3394018 - protein, 39 aa, Plasmodium falciparum
STNELMAFGFCEFSDIYEVYLCMNILDNIKLGDKHLKVN

SEQ ID NO: 3394019 - protein, 28 aa, Plasmodium falciparum
STNKETKKKLLKKLWTKIEDMKNNMMEE

SEQ ID NO: 3394020 - protein, 22 aa, Plasmodium falciparum
STNNYLMKIINNDKLKHNSLND

SEQ ID NO: 3394021 - protein, 24 aa, Plasmodium falciparum
STNTKKFNLFTNYYTSVGLDKLKG

SEQ ID NO: 3394022 - protein, 21 aa, Plasmodium falciparum
STNWWSSFMKVVRNDKFIKET

SEQ ID NO: 3394023 - protein, 17 aa, Plasmodium falciparum
STPKTLKPLPLPMHDQK

SEQ ID NO: 3394024 - protein, 19 aa, Plasmodium falciparum
STQELFNLLLKDVKKEEDF

SEQ ID NO: 3394025 - protein, 23 aa, Plasmodium falciparum
STQKFTIIYISKYICANLQNNTL

SEQ ID NO: 3394026 - protein, 21 aa, Plasmodium falciparum
STRAFPPFHPLVPLDYQYCGQ

SEQ ID NO: 3394027 - protein, 25 aa, Plasmodium falciparum
STREVLFFDYYLNKMKYNNLEKKKN

SEQ ID NO: 3394028 - protein, 18 aa, Plasmodium falciparum
STRRLMVRNIPFSTRDEQ

SEQ ID NO: 3394029 - protein, 18 aa, Plasmodium falciparum
STSLIYSFKNIIKKYIFD

SEQ ID NO: 3394030 - protein, 20 aa, Plasmodium falciparum
STSRKYILKKSNLNFLSIRI

SEQ ID NO: 3394031 - protein, 21 aa, Plasmodium falciparum
STSRLAFVTAFTISPYASVIG

SEQ ID NO: 3394032 - protein, 26 aa, Plasmodium falciparum
STSSLKFFYKTYMPDYEKIIENDKKA

SEQ ID NO: 3394033 - protein, 18 aa, Plasmodium falciparum
STTIKKKKTLTNSLYLIL

SEQ ID NO: 3394034 - protein, 28 aa, Plasmodium falciparum
STTKSNIYNLIMETDKLNSIFNMATNVL

SEQ ID NO: 3394035 - protein, 37 aa, Plasmodium falciparum
STTNSIINNNFTKPAYPLLNNILINNNINTSDLRDFN

SEQ ID NO: 3394036 - protein, 21 aa, Plasmodium falciparum
STVDRKWVALTAYQPVDVVTK

SEQ ID NO: 3394037 - protein, 26 aa, Plasmodium falciparum
STVSIAIWPLSYSKFPYMISASDDHT

SEQ ID NO: 3394038 - protein, 41 aa, Plasmodium falciparum
STYEVAKYCFEKLNGKWIPGKAHRFKLNWAKYNMSDNITTN

SEQ ID NO: 3394039 - protein, 29 aa, Plasmodium falciparum
STYPKKLIFYFPQFLKTWLKIMAHGTQEN

SEQ ID NO: 3394040 - protein, 32 aa, Plasmodium falciparum
STYSLYIKECLLIIDILYILNNTYGNLIYIKE

SEQ ID NO: 3394041 - protein, 32 aa, Plasmodium falciparum
SVAGLENLYISYMNISYKPIICYKCLSFFECE

SEQ ID NO: 3394042 - protein, 24 aa, Plasmodium falciparum
SVAVLKTYRKLKLAFYLILQTHQH

SEQ ID NO: 3394043 - protein, 22 aa, Plasmodium falciparum
SVDEQYYYYPYPCSLNHNEHTN

SEQ ID NO: 3394044 - protein, 23 aa, Plasmodium falciparum
SVDFSYTFFIYLLQDEISRKNNM

SEQ ID NO: 3394045 - protein, 27 aa, Plasmodium falciparum
SVDKKKIFFFGIIDIFTKWSIKKKFEH

SEQ ID NO: 3394046 - protein, 20 aa, Plasmodium falciparum
SVDKNNILHLFTLPDHIYKS

SEQ ID NO: 3394047 - protein, 23 aa, Plasmodium falciparum
SVDWTCQLLSIKNIKNPLIVFDS

SEQ ID NO: 3394048 - protein, 19 aa, Plasmodium falciparum
SVEELFNYIMKDIHMKNTY

SEQ ID NO: 3394049 - protein, 30 aa, Plasmodium falciparum
SVEGQLEFKALLFIPKRAPFDMFENRKKRN

SEQ ID NO: 3394050 - protein, 20 aa, Plasmodium falciparum
SVEHYFIYSVIWCFGGFLGE

SEQ ID NO: 3394051 - protein, 19 aa, Plasmodium falciparum
SVEKDLLFLYHYRKFDVYY

SEQ ID NO: 3394052 - protein, 19 aa, Plasmodium falciparum
SVERLSRKYLRAPAYISIG

SEQ ID NO: 3394053 - protein, 23 aa, Plasmodium falciparum
SVEYYFCCNICGIPCVNKFKKHK

SEQ ID NO: 3394054 - protein, 21 aa, Plasmodium falciparum
SVFGRIKWLKIMNESPHAYLY

SEQ ID NO: 3394055 - protein, 19 aa, Plasmodium falciparum
SVFGSYYDKHTKKWGYKCC

SEQ ID NO: 3394056 - protein, 17 aa, Plasmodium falciparum
SVFNEETCTIWDLVMKN

SEQ ID NO: 3394057 - protein, 17 aa, Plasmodium falciparum
SVFSLKMKYKFNNNIMD

SEQ ID NO: 3394058 - protein, 18 aa, Plasmodium falciparum
SVGKSCIVVRFAKNEFYE

SEQ ID NO: 3394059 - protein, 24 aa, Plasmodium falciparum
SVHAKVFNYFKRAFNEEGIVVNMK

SEQ ID NO: 3394060 - protein, 25 aa, Plasmodium falciparum
SVIKNWLELIKPIVTHLKLEIRMNK

SEQ ID NO: 3394061 - protein, 18 aa, Plasmodium falciparum
SVKCNINWFFPGKHLFES

SEQ ID NO: 3394062 - protein, 23 aa, Plasmodium falciparum
SVKGLDWLLQEIEKIFYKSLCHP

SEQ ID NO: 3394063 - protein, 26 aa, Plasmodium falciparum
SVKKKMMMTNYPYLEKGKLLNGNMNI

SEQ ID NO: 3394064 - protein, 27 aa, Plasmodium falciparum
SVKKLLGLVIKMRIICGHPKGIVSRPS

SEQ ID NO: 3394065 - protein, 24 aa, Plasmodium falciparum
SVKKNDFTLLYKILSYMKNNGIEL

SEQ ID NO: 3394066 - protein, 20 aa, Plasmodium falciparum
SVKLEIYLELSKRVKPLLTD

SEQ ID NO: 3394067 - protein, 19 aa, Plasmodium falciparum
SVLFLLSSFIMNKKCSYVH

SEQ ID NO: 3394068 - protein, 26 aa, Plasmodium falciparum
SVLFNDPIYYIFPSKCIKVKKAEHIS

SEQ ID NO: 3394069 - protein, 25 aa, Plasmodium falciparum
SVLKKKHYAPIVFQALHSTYINIDE

SEQ ID NO: 3394070 - protein, 24 aa, Plasmodium falciparum
SVLKYITILILKKDKYLLLQKKKI

SEQ ID NO: 3394071 - protein, 18 aa, Plasmodium falciparum
SVLLLRHVFRSMRKIVSD

SEQ ID NO: 3394072 - protein, 19 aa, Plasmodium falciparum
SVLLRHEIAYVIGQISNEK

SEQ ID NO: 3394073 - protein, 21 aa, Plasmodium falciparum
SVLSPKLGPLGLSPKKVGDDI

SEQ ID NO: 3394074 - protein, 18 aa, Plasmodium falciparum
SVLTHKYKYRSNIIFTIN

SEQ ID NO: 3394075 - protein, 46 aa, Plasmodium falciparum
SVMDDVFNKVIIPGGFFENNNFCPIFLKLLKIDIYNTCYTVDTKVN

SEQ ID NO: 3394076 - protein, 20 aa, Plasmodium falciparum
SVMLNMNLPAALLTRFDLQF

SEQ ID NO: 3394077 - protein, 17 aa, Plasmodium falciparum
SVNCFMNINKKTKEVYN

SEQ ID NO: 3394078 - protein, 27 aa, Plasmodium falciparum
SVNFMKGKNLFIVKFVSTDSALNAYKN

SEQ ID NO: 3394079 - protein, 25 aa, Plasmodium falciparum
SVNFPDFLVEKLTKLSFLCLNPNIK

SEQ ID NO: 3394080 - protein, 25 aa, Plasmodium falciparum
SVNRSYTSFLMNIGSSYLKKKKTAE

SEQ ID NO: 3394081 - protein, 24 aa, Plasmodium falciparum
SVNSENILIVRKLKEKRKLEERIN

SEQ ID NO: 3394082 - protein, 28 aa, Plasmodium falciparum
SVNVLPFWHKYIFDFEYFNYVQSKVFNS

SEQ ID NO: 3394083 - protein, 27 aa, Plasmodium falciparum
SVNVSSYLYYFKLINKKKLNMKINQME

SEQ ID NO: 3394084 - protein, 24 aa, Plasmodium falciparum
SVQDSYQYYALKDDMYKLSNENKE

SEQ ID NO: 3394085 - protein, 24 aa, Plasmodium falciparum
SVQINFCYFFINNDIDFGKKNIAN

SEQ ID NO: 3394086 - protein, 33 aa, Plasmodium falciparum
SVQIQLYSQNFLKYLFLQIYKTLISLLKKNVAY

SEQ ID NO: 3394087 - protein, 29 aa, Plasmodium falciparum
SVQNDMLVNPMLYRNYIYSTNAEADNMKM

SEQ ID NO: 3394088 - protein, 24 aa, Plasmodium falciparum
SVQPFVTCPDFYANNIKSIYLDPN

SEQ ID NO: 3394089 - protein, 19 aa, Plasmodium falciparum
SVQSYDYEILKYPCRSVLN

SEQ ID NO: 3394090 - protein, 18 aa, Plasmodium falciparum
SVRAGPFGQLFRPDNFVF

SEQ ID NO: 3394091 - protein, 30 aa, Plasmodium falciparum
SVRRSRWIQSLLDFYGVNLFKAESSATCGG

SEQ ID NO: 3394092 - protein, 22 aa, Plasmodium falciparum
SVSFLKIFHDKNTDKEDIIHNK

SEQ ID NO: 3394093 - protein, 25 aa, Plasmodium falciparum
SVSRFHALIKFHNGNFYIEDCKSKF

SEQ ID NO: 3394094 - protein, 34 aa, Plasmodium falciparum
SVSVYGHENARLFALFELIKYNCVPDSLKEEATI

SEQ ID NO: 3394095 - protein, 48 aa, Plasmodium falciparum
SVTKFDPYHETPFYLNEKKLRAYQLTGLNWIVSRMKRNLSVLLADEMG

SEQ ID NO: 3394096 - protein, 25 aa, Plasmodium falciparum
SVTKNFLLCYVGMCSIFLYYDNEEE

SEQ ID NO: 3394097 - protein, 20 aa, Plasmodium falciparum
SVTRKSLGYAYVNYHNLADA

SEQ ID NO: 3394098 - protein, 28 aa, Plasmodium falciparum
SVTTMDIFLALEYYVNKVAINSLSIYPY

SEQ ID NO: 3394099 - protein, 23 aa, Plasmodium falciparum
SVYETKIPLYFDFLSRYGNSVEI

SEQ ID NO: 3394100 - protein, 26 aa, Plasmodium falciparum
SVYNLVYNYIDLSVFSAFHPLFKKRY

SEQ ID NO: 3394101 - protein, 18 aa, Plasmodium falciparum
SVYSFLKEKGLLVLMYHA

SEQ ID NO: 3394102 - protein, 26 aa, Plasmodium falciparum
SWCGFKKRWFVLRNNKLYYYKNEKSL

SEQ ID NO: 3394103 - protein, 25 aa, Plasmodium falciparum
SWDDVLILSFIFPNVEILSLKKNYI

SEQ ID NO: 3394104 - protein, 17 aa, Plasmodium falciparum
SWGAPYAVFECDKKKII

SEQ ID NO: 3394105 - protein, 17 aa, Plasmodium falciparum
SWLPSDADEQLALGFKI

SEQ ID NO: 3394106 - protein, 18 aa, Plasmodium falciparum
SWNWVKIERITFAGACNP

SEQ ID NO: 3394107 - protein, 27 aa, Plasmodium falciparum
SYAKNGFKKYVNFLNNYKNTIKEEQNE

SEQ ID NO: 3394108 - protein, 20 aa, Plasmodium falciparum
SYALHYANKMKIPPSSPKML

SEQ ID NO: 3394109 - protein, 30 aa, Plasmodium falciparum
SYASKNILLKYGKWKNGKLKKWLYASDDSI

SEQ ID NO: 3394110 - protein, 21 aa, Plasmodium falciparum
SYDCFILSLSLMNTDWPKIIF

SEQ ID NO: 3394111 - protein, 28 aa, Plasmodium falciparum
SYDCGIYIIQFILHLCLNKHLVERDLIN

SEQ ID NO: 3394112 - protein, 18 aa, Plasmodium falciparum
SYDFYLLFNNISCILYNF

SEQ ID NO: 3394113 - protein, 27 aa, Plasmodium falciparum
SYDGINKVPLWLAAWATASAPTYLKGP

SEQ ID NO: 3394114 - protein, 22 aa, Plasmodium falciparum
SYDGTFFFELPQKRDINLPYIL

SEQ ID NO: 3394115 - protein, 23 aa, Plasmodium falciparum
SYDKLSFLYFFSGHIEKLKKMLS

SEQ ID NO: 3394116 - protein, 17 aa, Plasmodium falciparum
SYDKLYEDVYMIRSLNA

SEQ ID NO: 3394117 - protein, 25 aa, Plasmodium falciparum
SYDKTLKLFDIRKFRELCIYKGNHT

SEQ ID NO: 3394118 - protein, 23 aa, Plasmodium falciparum
SYEDIKRNIWLQNIDFQKNINRK

SEQ ID NO: 3394119 - protein, 23 aa, Plasmodium falciparum
SYENLLMCVIRYIVPHKDHRLKK

SEQ ID NO: 3394120 - protein, 26 aa, Plasmodium falciparum
SYEQKEILQLLQKFNKLFQKRSSKDH

SEQ ID NO: 3394121 - protein, 19 aa, Plasmodium falciparum
SYFCSPAPSNSILRNNTES

SEQ ID NO: 3394122 - protein, 19 aa, Plasmodium falciparum
SYFFNRYCINADKFNYDII

SEQ ID NO: 3394123 - protein, 22 aa, Plasmodium falciparum
SYFGQILVLTFPSIGNYGIEKV

SEQ ID NO: 3394124 - protein, 24 aa, Plasmodium falciparum
SYFNKKFQIIYMKEFFNLLKEHNI

SEQ ID NO: 3394125 - protein, 25 aa, Plasmodium falciparum
SYFRIYCENLCFLSKLFLDHKTLKH

SEQ ID NO: 3394126 - protein, 17 aa, Plasmodium falciparum
SYGLYIFKVLKQVHPDT

SEQ ID NO: 3394127 - protein, 24 aa, Plasmodium falciparum
SYGNLAYLYMKKGTYKAAKICINQ

SEQ ID NO: 3394128 - protein, 28 aa, Plasmodium falciparum
SYGSCFTSPLWFYHSLKDLKEGQQIIIP

SEQ ID NO: 3394129 - protein, 25 aa, Plasmodium falciparum
SYIINNMYFKFFFNHNKELVCNNQN

SEQ ID NO: 3394130 - protein, 20 aa, Plasmodium falciparum
SYINDTVRSAFHKKFLFKYI

SEQ ID NO: 3394131 - protein, 18 aa, Plasmodium falciparum
SYINPKYFKVFSLNEIDT

SEQ ID NO: 3394132 - protein, 21 aa, Plasmodium falciparum
SYINSQLSPFELKPVENYINI

SEQ ID NO: 3394133 - protein, 20 aa, Plasmodium falciparum
SYISCLLKKMNIAIVTAASY

SEQ ID NO: 3394134 - protein, 21 aa, Plasmodium falciparum
SYIYNNICTPTNFIQDLIKTN

SEQ ID NO: 3394135 - protein, 28 aa, Plasmodium falciparum
SYKNKLEEYIFLTRHKDLKIKKLEEELN

SEQ ID NO: 3394136 - protein, 23 aa, Plasmodium falciparum
SYKNNIMIKKCNSLVLPTLNNKN

SEQ ID NO: 3394137 - protein, 27 aa, Plasmodium falciparum
SYKSLEFLEIMNLYRNVDFHKNMCRVD

SEQ ID NO: 3394138 - protein, 18 aa, Plasmodium falciparum
SYKYTVCFYIQNNKLLYS

SEQ ID NO: 3394139 - protein, 22 aa, Plasmodium falciparum
SYLCGNSKIISFYPSTNIKNSD

SEQ ID NO: 3394140 - protein, 24 aa, Plasmodium falciparum
SYLDCPDIVILFWCFSKIGYRDNR

SEQ ID NO: 3394141 - protein, 18 aa, Plasmodium falciparum
SYLLIFKKKNERISKFDE

SEQ ID NO: 3394142 - protein, 26 aa, Plasmodium falciparum
SYLNRAIESPLAPILIMATNRGICTV

SEQ ID NO: 3394143 - protein, 30 aa, Plasmodium falciparum
SYLTPAYIKQGVIELLFEYFNMNQIVIVSS

SEQ ID NO: 3394144 - protein, 17 aa, Plasmodium falciparum
SYLYIKKIGNQITNAVI

SEQ ID NO: 3394145 - protein, 18 aa, Plasmodium falciparum
SYMLSLLNKKICNHLYEE

SEQ ID NO: 3394146 - protein, 17 aa, Plasmodium falciparum
SYNFLTPAQVFFENNKE

SEQ ID NO: 3394147 - protein, 26 aa, Plasmodium falciparum
SYNIPFNYLSLEQFIWDFFTYVEMQI

SEQ ID NO: 3394148 - protein, 22 aa, Plasmodium falciparum
SYNLLCPYNLFYNKFKNQGNTN

SEQ ID NO: 3394149 - protein, 17 aa, Plasmodium falciparum
SYNMFILKDSFVDALHK

SEQ ID NO: 3394150 - protein, 24 aa, Plasmodium falciparum
SYNNIREMYLYPSRIEKCRKDNLN

SEQ ID NO: 3394151 - protein, 19 aa, Plasmodium falciparum
SYQLIKLYELMKEFNIHNS

SEQ ID NO: 3394152 - protein, 20 aa, Plasmodium falciparum
SYSSLFHNILRSISKNIRND

SEQ ID NO: 3394153 - protein, 29 aa, Plasmodium falciparum
SYSYKYICKLFLKSDMPILFIGKTGVGKT

SEQ ID NO: 3394154 - protein, 20 aa, Plasmodium falciparum
SYSYNWIYLEKKKIWKSENI

SEQ ID NO: 3394155 - protein, 34 aa, Plasmodium falciparum
SYVHKSFHDLPPYGIPSLFNIKFDRSKTVIEAFY

SEQ ID NO: 3394156 - protein, 20 aa, Plasmodium falciparum
SYVHWDNMIVLKEFFKIIND

SEQ ID NO: 3394157 - protein, 27 aa, Plasmodium falciparum
SYYCRNDMWTFFFKNSLFKINKNKKMK

SEQ ID NO: 3394158 - protein, 20 aa, Plasmodium falciparum
SYYINILDILILLKHTNKYN

SEQ ID NO: 3394159 - protein, 20 aa, Plasmodium falciparum
TACVSVIFKNMLYVANIGDS

SEQ ID NO: 3394160 - protein, 27 aa, Plasmodium falciparum
TADKSKLYLLFQNIHGSILKTYSTPLE

SEQ ID NO: 3394161 - protein, 25 aa, Plasmodium falciparum
TAEKFYVDYILKRKPCILKSEYVIK

SEQ ID NO: 3394162 - protein, 23 aa, Plasmodium falciparum
TAEKLVYNYYQRTLLNSMKSKNK

SEQ ID NO: 3394163 - protein, 24 aa, Plasmodium falciparum
TAFNDIFFHPKFSNALGVCDDNGY

SEQ ID NO: 3394164 - protein, 24 aa, Plasmodium falciparum
TAGCYFYQLDNLSTLGFRVISLQY

SEQ ID NO: 3394165 - protein, 23 aa, Plasmodium falciparum
TAKKIALNFLRSLGVNADYLENN

SEQ ID NO: 3394166 - protein, 26 aa, Plasmodium falciparum
TAKSEILKYVESFAPRAIFTSGKGST

SEQ ID NO: 3394167 - protein, 25 aa, Plasmodium falciparum
TALFNKFHPHLIIGGTYTGNVVLWD

SEQ ID NO: 3394168 - protein, 32 aa, Plasmodium falciparum
TAMSSMAVLLLTKNILLTTIKIDPYLNIDAGT

SEQ ID NO: 3394169 - protein, 27 aa, Plasmodium falciparum
TANRNYINPLIYINEKQQNCFKGNYNE

SEQ ID NO: 3394170 - protein, 34 aa, Plasmodium falciparum
TAQSIYEKRKVLLTKLLLLFKKNVDTQINNETSD

SEQ ID NO: 3394171 - protein, 23 aa, Plasmodium falciparum
TAQSPRGWAFITYEQRSEAYKAI

SEQ ID NO: 3394172 - protein, 27 aa, Plasmodium falciparum
TASLYPSHPLAMTYLQNKWIQTDTLKT

SEQ ID NO: 3394173 - protein, 23 aa, Plasmodium falciparum
TAVLVYNMEYFYGGGILCLEQQE

SEQ ID NO: 3394174 - protein, 20 aa, Plasmodium falciparum
TAYNIFLSLDPLDLSKNGED

SEQ ID NO: 3394175 - protein, 18 aa, Plasmodium falciparum
TCAPLLSVLMPLDSLTNE

SEQ ID NO: 3394176 - protein, 18 aa, Plasmodium falciparum
TCDHLFIEKLYHMIENLD

SEQ ID NO: 3394177 - protein, 35 aa, Plasmodium falciparum
TCDLLEHQYWLKGNSPKMQFLKKKIKQLGDLLEKC

SEQ ID NO: 3394178 - protein, 19 aa, Plasmodium falciparum
TCDSWYTNIVLLKNEIMLE

SEQ ID NO: 3394179 - protein, 27 aa, Plasmodium falciparum
TCEYPMAEAMLWFLLTKEVPAVDDLKL

SEQ ID NO: 3394180 - protein, 26 aa, Plasmodium falciparum
TCGGQLGFFDILYKKNITSNNISNEY

SEQ ID NO: 3394181 - protein, 20 aa, Plasmodium falciparum
TCHMPYWMMQQLNLKEGDIV

SEQ ID NO: 3394182 - protein, 21 aa, Plasmodium falciparum
TCIKFIPRHSVKTSPAIIVNS

SEQ ID NO: 3394183 - protein, 32 aa, Plasmodium falciparum
TCKASKNDNKWLRFFRFNKKTNPNEEKILKEL

SEQ ID NO: 3394184 - protein, 29 aa, Plasmodium falciparum
TCKKFKVNHLYFIPKLKALVHVNHLKRTA

SEQ ID NO: 3394185 - protein, 23 aa, Plasmodium falciparum
TCKKNFFLFVKMKEEIDMKKLKK

SEQ ID NO: 3394186 - protein, 19 aa, Plasmodium falciparum
TCKYLFSIEENHKFLEHEN

SEQ ID NO: 3394187 - protein, 25 aa, Plasmodium falciparum
TCLCVEFFFHLFKNIFNTKKINKQN

SEQ ID NO: 3394188 - protein, 27 aa, Plasmodium falciparum
TCLYDLFCGIGFYSIPLANLFDHVISI

SEQ ID NO: 3394189 - protein, 19 aa, Plasmodium falciparum
TCMKTITTILEWLEKNQLA

SEQ ID NO: 3394190 - protein, 31 aa, Plasmodium falciparum
TCNIQIYNYSFFRYHFKSEWHKYNLKRKLLN

SEQ ID NO: 3394191 - protein, 18 aa, Plasmodium falciparum
TCNKFFENSYIKLSKSTL

SEQ ID NO: 3394192 - protein, 19 aa, Plasmodium falciparum
TCNLFNPMASCDTYNNAYN

SEQ ID NO: 3394193 - protein, 19 aa, Plasmodium falciparum
TCNNGFNVYYDLKKGKECQ

SEQ ID NO: 3394194 - protein, 25 aa, Plasmodium falciparum
TCPLHLCLILSAFARLDIREGNILL

SEQ ID NO: 3394195 - protein, 23 aa, Plasmodium falciparum
TCPLKSFILSFFLLSIMSRTNNS

SEQ ID NO: 3394196 - protein, 18 aa, Plasmodium falciparum
TCQKLFYSFGSRSAVIRL

SEQ ID NO: 3394197 - protein, 20 aa, Plasmodium falciparum
TCRICLFSGSIFKHPNASKL

SEQ ID NO: 3394198 - protein, 22 aa, Plasmodium falciparum
TCSMLLHDILNILNQNIKYDEP

SEQ ID NO: 3394199 - protein, 22 aa, Plasmodium falciparum
TCSVFNNFDFRINSEWQLVYLD

SEQ ID NO: 3394200 - protein, 26 aa, Plasmodium falciparum
TCSYKYRYFIVPFSKLLSSCCPTFRL

SEQ ID NO: 3394201 - protein, 22 aa, Plasmodium falciparum
TCTNYAIWKLGPTPSQTKKFTH

SEQ ID NO: 3394202 - protein, 18 aa, Plasmodium falciparum
TCYSLLYEFLSKDKQYII

SEQ ID NO: 3394203 - protein, 18 aa, Plasmodium falciparum
TDCRMLPKNVLLYGIKNI

SEQ ID NO: 3394204 - protein, 18 aa, Plasmodium falciparum
TDCYIRLLVNNKVILTYG

SEQ ID NO: 3394205 - protein, 25 aa, Plasmodium falciparum
TDDENLIRGIYVYGFGSFNEICADA

SEQ ID NO: 3394206 - protein, 24 aa, Plasmodium falciparum
TDDKILMLYWHILGDMSRYCADTF

SEQ ID NO: 3394207 - protein, 26 aa, Plasmodium falciparum
TDDKKIREFFFFYEHMNNKNVGEQHH

SEQ ID NO: 3394208 - protein, 41 aa, Plasmodium falciparum
TDDTSFYNTDFLLIRNFSYNQNRYFLKPLYVDVDMYREEYK

SEQ ID NO: 3394209 - protein, 59 aa, Plasmodium falciparum
TDENVIKFIPDEKIIWSILKSDISPSLTQFFFNFIIKKNQYNFFLNKSYIKYDNHMDDI

SEQ ID NO: 3394210 - protein, 24 aa, Plasmodium falciparum
TDEQFLMFNIIDQKEKIYCNVNYN

SEQ ID NO: 3394211 - protein, 25 aa, Plasmodium falciparum
TDERDRSRYKRRSTSSSLHKYKKRK

SEQ ID NO: 3394212 - protein, 23 aa, Plasmodium falciparum
TDFHPYICAVFLVHWSKHLQKMD

SEQ ID NO: 3394213 - protein, 19 aa, Plasmodium falciparum
TDFINSFTSFDKLGNDNKC

SEQ ID NO: 3394214 - protein, 19 aa, Plasmodium falciparum
TDFRNTIFDLFLHRKWELT

SEQ ID NO: 3394215 - protein, 25 aa, Plasmodium falciparum
TDGFCTRRLINRPPIILRTLTNNCI

SEQ ID NO: 3394216 - protein, 30 aa, Plasmodium falciparum
TDGKIIKVSKVICGCLIEYLDNTSELNIKC

SEQ ID NO: 3394217 - protein, 35 aa, Plasmodium falciparum
TDHLNLLKNYNLNNYINLLKINKLNDYYYNSIINK

SEQ ID NO: 3394218 - protein, 36 aa, Plasmodium falciparum
TDIENEIILLKNIRPFPTIYWLINKNICGYISHLEK

SEQ ID NO: 3394219 - protein, 26 aa, Plasmodium falciparum
TDIGRKMVQFPLDPPLSKIVIYSQNF

SEQ ID NO: 3394220 - protein, 18 aa, Plasmodium falciparum
TDIPEHFLKKIYFDDKEC

SEQ ID NO: 3394221 - protein, 24 aa, Plasmodium falciparum
TDITKMDFLKYYTLVYNNKSAYIN

SEQ ID NO: 3394222 - protein, 25 aa, Plasmodium falciparum
TDITNLIYNFYYINNFFFKTLINKI

SEQ ID NO: 3394223 - protein, 21 aa, Plasmodium falciparum
TDKLTKVLLRHIKNFLPDIKI

SEQ ID NO: 3394224 - protein, 29 aa, Plasmodium falciparum
TDKQIIFFEEYLFVCYIMITLVEIEVDKL

SEQ ID NO: 3394225 - protein, 31 aa, Plasmodium falciparum
TDKQTSFFTLPFITILLIFKDIEFNKNLFQN

SEQ ID NO: 3394226 - protein, 32 aa, Plasmodium falciparum
TDKVRYVYQPLDNIYIFLITNINSNIIEDLEI

SEQ ID NO: 3394227 - protein, 23 aa, Plasmodium falciparum
TDKWGFNIWSEDIKFPIISNYYN

SEQ ID NO: 3394228 - protein, 26 aa, Plasmodium falciparum
TDLASSLYYITLKDSKEFLKDSFDLD

SEQ ID NO: 3394229 - protein, 27 aa, Plasmodium falciparum
TDLGKKLCLFPLNPIYANILLCSIEFN

SEQ ID NO: 3394230 - protein, 31 aa, Plasmodium falciparum
TDLLSIEKQKRIFLYINHMGRINLEHYKSSL

SEQ ID NO: 3394231 - protein, 21 aa, Plasmodium falciparum
TDMRNICFFLGQILAIKGKKE

SEQ ID NO: 3394232 - protein, 35 aa, Plasmodium falciparum
TDNERCRHVFHCSCIIPWLKERNSCPTCRFELPTD

SEQ ID NO: 3394233 - protein, 22 aa, Plasmodium falciparum
TDNFFSILHKLLSFKPEDILNN

SEQ ID NO: 3394234 - protein, 29 aa, Plasmodium falciparum
TDNGNSFVLRYLLSFLTNKISSLRKCYAN

SEQ ID NO: 3394235 - protein, 25 aa, Plasmodium falciparum
TDNIKTVSPKLKHNKRTFYRSNSGS

SEQ ID NO: 3394236 - protein, 25 aa, Plasmodium falciparum
TDNMNINLMLPGNLGEFLPKFLIDN

SEQ ID NO: 3394237 - protein, 19 aa, Plasmodium falciparum
TDPFHIFSNGYLYVPPAIE

SEQ ID NO: 3394238 - protein, 21 aa, Plasmodium falciparum
TDPGLLVLAVNVLGKFLQNND

SEQ ID NO: 3394239 - protein, 22 aa, Plasmodium falciparum
TDPSFLEYIRQNQTEFLAALQN

SEQ ID NO: 3394240 - protein, 24 aa, Plasmodium falciparum
TDQIGSMKILFDEDNKNFLLNLNN

SEQ ID NO: 3394241 - protein, 22 aa, Plasmodium falciparum
TDQNIFIHLYNKCTHLITNIHD

SEQ ID NO: 3394242 - protein, 24 aa, Plasmodium falciparum
TDQNYIFYRIINEETNVRNIYSLW

SEQ ID NO: 3394243 - protein, 35 aa, Plasmodium falciparum
TDRNFFPCDCGYQICLWCLYYIRDHMNNTCPACRR

SEQ ID NO: 3394244 - protein, 18 aa, Plasmodium falciparum
TDSLLYIKHVLHDINNFY

SEQ ID NO: 3394245 - protein, 17 aa, Plasmodium falciparum
TDTPMKYYMDTLNYFDN

SEQ ID NO: 3394246 - protein, 17 aa, Plasmodium falciparum
TDVHLRSLLGNVGFIKD

SEQ ID NO: 3394247 - protein, 24 aa, Plasmodium falciparum
TDVKEPLQHALWMNNNANTNININ

SEQ ID NO: 3394248 - protein, 21 aa, Plasmodium falciparum
TDWVSYFTYFTSDVVYCYLKL

SEQ ID NO: 3394249 - protein, 25 aa, Plasmodium falciparum
TDYDDIILFILKNSVFYVSWVTSSE

SEQ ID NO: 3394250 - protein, 24 aa, Plasmodium falciparum
TEAAKNYYYYVKCQKTFSDKKRLV

SEQ ID NO: 3394251 - protein, 25 aa, Plasmodium falciparum
TEDADALVFGTKILIRNLNANATSN

SEQ ID NO: 3394252 - protein, 27 aa, Plasmodium falciparum
TEDGTDQFLRWLIEWAMQACKEKKRVR

SEQ ID NO: 3394253 - protein, 27 aa, Plasmodium falciparum
TEDIYKYDQIYILKDGSYGILKDVEDV

SEQ ID NO: 3394254 - protein, 26 aa, Plasmodium falciparum
TEEEDLKIIFSRFGNIKSCKIIKDKV

SEQ ID NO: 3394255 - protein, 23 aa, Plasmodium falciparum
TEEFYENICYLYDLIRNEKIYPS

SEQ ID NO: 3394256 - protein, 24 aa, Plasmodium falciparum
TEEIKLQWALLQHENLYTVNEYNK

SEQ ID NO: 3394257 - protein, 27 aa, Plasmodium falciparum
TEEQLKKLIYGIGFYNVKAKQILQICH

SEQ ID NO: 3394258 - protein, 23 aa, Plasmodium falciparum
TEEVLKKFLPNNEINIMSYYYNH

SEQ ID NO: 3394259 - protein, 32 aa, Plasmodium falciparum
TEFNNMKIRKTCGWIIFVIQNCEIIIHSKGAS

SEQ ID NO: 3394260 - protein, 33 aa, Plasmodium falciparum
TEFQTNLVPYPRIHFMLSSYAPIISAEKAYHEQ

SEQ ID NO: 3394261 - protein, 33 aa, Plasmodium falciparum
TEFQTNLVPYPRIHFMLSSYAPVVSAEKAYHEQ

SEQ ID NO: 3394262 - protein, 18 aa, Plasmodium falciparum
TEFVYEAMKYYYYNMELN

SEQ ID NO: 3394263 - protein, 22 aa, Plasmodium falciparum
TEGLLDIFHFYDTNKTGKISKE

SEQ ID NO: 3394264 - protein, 34 aa, Plasmodium falciparum
TEGTTIIKPYFLNIYVFTCFINFCIHYKNISICK

SEQ ID NO: 3394265 - protein, 26 aa, Plasmodium falciparum
TEGVGKIFLHYADEATARKAQYMFNG

SEQ ID NO: 3394266 - protein, 20 aa, Plasmodium falciparum
TEIGLVYFLLSKENSIMCPE

SEQ ID NO: 3394267 - protein, 25 aa, Plasmodium falciparum
TEIIMKSCFVTVYKMKDDELKWKRA

SEQ ID NO: 3394268 - protein, 26 aa, Plasmodium falciparum
TEIKKKNTLFLLPFCPKDVTNVKKKK

SEQ ID NO: 3394269 - protein, 25 aa, Plasmodium falciparum
TEKKKHILKLFSKNSFHANKQDTTM

SEQ ID NO: 3394270 - protein, 20 aa, Plasmodium falciparum
TEKLYYEHIFEEINKHTNDT

SEQ ID NO: 3394271 - protein, 25 aa, Plasmodium falciparum
TEKNFKYLITWWKEKGYWNRQNERL

SEQ ID NO: 3394272 - protein, 32 aa, Plasmodium falciparum
TELLLKNDANIHALLPHSLSPNRGKTTASMGI

SEQ ID NO: 3394273 - protein, 19 aa, Plasmodium falciparum
TELPFPCDYNTYGHFCLSN

SEQ ID NO: 3394274 - protein, 21 aa, Plasmodium falciparum
TENFIPFFKINHVNTLLTTVE

SEQ ID NO: 3394275 - protein, 20 aa, Plasmodium falciparum
TENFLRNIEKRYVSNKINEL

SEQ ID NO: 3394276 - protein, 33 aa, Plasmodium falciparum
TENKTDLIIYIKKFLLDKFLYVKFEKKEANLFH

SEQ ID NO: 3394277 - protein, 25 aa, Plasmodium falciparum
TEQMTLKLIYLIMPHKDYLGDHKID

SEQ ID NO: 3394278 - protein, 25 aa, Plasmodium falciparum
TERNILKVFNKCKYILKKNIYKNVF

SEQ ID NO: 3394279 - protein, 28 aa, Plasmodium falciparum
TESECKFLFFQIASGISFIQTCYQSNIV

SEQ ID NO: 3394280 - protein, 26 aa, Plasmodium falciparum
TESLKLIFPYIFFRKKYNQNNINKLC

SEQ ID NO: 3394281 - protein, 22 aa, Plasmodium falciparum
TETDFVYIYKIRKNVYLDDDTL

SEQ ID NO: 3394282 - protein, 26 aa, Plasmodium falciparum
TEVHIYPIFIDYFNIFVLQIKNYKKI

SEQ ID NO: 3394283 - protein, 33 aa, Plasmodium falciparum
TEVNYMKYIYDDLFLHYLIRCSHKNNISMGYGE

SEQ ID NO: 3394284 - protein, 36 aa, Plasmodium falciparum
TEYNLLLPRSIFRKWTRTLYYYWKDKYMHYYHNTLC

SEQ ID NO: 3394285 - protein, 20 aa, Plasmodium falciparum
TFAAFKDIALYLGYKEKDIN

SEQ ID NO: 3394286 - protein, 33 aa, Plasmodium falciparum
TFAQSMIKGIFNPILLHKATGTRFSRSDKSVVK

SEQ ID NO: 3394287 - protein, 33 aa, Plasmodium falciparum
TFATEMFHFFLTSKEIILPYNLVHKVLIKTKKM

SEQ ID NO: 3394288 - protein, 25 aa, Plasmodium falciparum
TFCNIIRNYNIFYEFIQRCKKIHEH

SEQ ID NO: 3394289 - protein, 26 aa, Plasmodium falciparum
TFDSLEKLDMLLKSKYKSINNKYNNN

SEQ ID NO: 3394290 - protein, 27 aa, Plasmodium falciparum
TFESGRTPLYRRLPKWPEAWLSRQKKN

SEQ ID NO: 3394291 - protein, 17 aa, Plasmodium falciparum
TFEVEYPMDLIITNENK

SEQ ID NO: 3394292 - protein, 21 aa, Plasmodium falciparum
TFFDYTLPEPVPKLDRQRAAN

SEQ ID NO: 3394293 - protein, 24 aa, Plasmodium falciparum
TFGNVYFYKYYNQKYSNMFYISVS

SEQ ID NO: 3394294 - protein, 19 aa, Plasmodium falciparum
TFGQLKYDSALESNLINFI

SEQ ID NO: 3394295 - protein, 22 aa, Plasmodium falciparum
TFGYICMIAVHKSIRSLGLGSY

SEQ ID NO: 3394296 - protein, 21 aa, Plasmodium falciparum
TFGYIYIYNITNNRLINKYFV

SEQ ID NO: 3394297 - protein, 17 aa, Plasmodium falciparum
TFHYNYLCRILQCFQHL

SEQ ID NO: 3394298 - protein, 17 aa, Plasmodium falciparum
TFIIPCCLNKNILSCFL

SEQ ID NO: 3394299 - protein, 18 aa, Plasmodium falciparum
TFINMDTSFFITTKKNIK

SEQ ID NO: 3394300 - protein, 24 aa, Plasmodium falciparum
TFIQALHFRYNYFPDLDLSIEDYQ

SEQ ID NO: 3394301 - protein, 18 aa, Plasmodium falciparum
TFKDSKYFYFLTELVTGG

SEQ ID NO: 3394302 - protein, 26 aa, Plasmodium falciparum
TFKGANHIIFFSPPKFVFMYSELIKN

SEQ ID NO: 3394303 - protein, 18 aa, Plasmodium falciparum
TFKHFFFDNVPKVIHIEK

SEQ ID NO: 3394304 - protein, 18 aa, Plasmodium falciparum
TFKILKYFYTFVNKNELV

SEQ ID NO: 3394305 - protein, 26 aa, Plasmodium falciparum
TFKKRDDSFLIYKESIKSFNNNHLSS

SEQ ID NO: 3394306 - protein, 18 aa, Plasmodium falciparum
TFKVKRFHVFKDYAFFIN

SEQ ID NO: 3394307 - protein, 17 aa, Plasmodium falciparum
TFLFQLSTSYDEYIRVL

SEQ ID NO: 3394308 - protein, 18 aa, Plasmodium falciparum
TFLIIKNYYNVWVGYNKN

SEQ ID NO: 3394309 - protein, 24 aa, Plasmodium falciparum
TFLKCSDFLHNLPSIILNNKHFEK

SEQ ID NO: 3394310 - protein, 20 aa, Plasmodium falciparum
TFLKTKYGYYSFEKISLAIN

SEQ ID NO: 3394311 - protein, 34 aa, Plasmodium falciparum
TFLPCLKEDPFTKKWLLQLLYNINNDDENLTMKN

SEQ ID NO: 3394312 - protein, 19 aa, Plasmodium falciparum
TFLQILERFNKLFKRKAHL

SEQ ID NO: 3394313 - protein, 28 aa, Plasmodium falciparum
TFLTYNHYFIIRKWISYTSYNKIHEKGL

SEQ ID NO: 3394314 - protein, 29 aa, Plasmodium falciparum
TFMSNMLYACSVLYKSRLPFLACFNKTDI

SEQ ID NO: 3394315 - protein, 27 aa, Plasmodium falciparum
TFNNDCRTLFIGSIFINNINQVPVIEK

SEQ ID NO: 3394316 - protein, 26 aa, Plasmodium falciparum
TFNNHPNFYTNYYQSFIKNDNIPYIN

SEQ ID NO: 3394317 - protein, 18 aa, Plasmodium falciparum
TFNTVDLLRSSLAGEKIN

SEQ ID NO: 3394318 - protein, 39 aa, Plasmodium falciparum
TFPHSMNIWEREGKINMNTLKSAFYKYEDMKLNLNNNDE

SEQ ID NO: 3394319 - protein, 19 aa, Plasmodium falciparum
TFPHTFHYSIIWHGSSIVD

SEQ ID NO: 3394320 - protein, 20 aa, Plasmodium falciparum
TFPQFIIKELLQVDLRSMRF

SEQ ID NO: 3394321 - protein, 23 aa, Plasmodium falciparum
TFPRKSMVHINNLENINIKNVQE

SEQ ID NO: 3394322 - protein, 20 aa, Plasmodium falciparum
TFQFDKILLDAPCSGTGVVN

SEQ ID NO: 3394323 - protein, 17 aa, Plasmodium falciparum
TFQMKISYPSLALIVFE

SEQ ID NO: 3394324 - protein, 17 aa, Plasmodium falciparum
TFRLFYESYICLSVIKN

SEQ ID NO: 3394325 - protein, 17 aa, Plasmodium falciparum
TFRLTKELLDDLNKRNE

SEQ ID NO: 3394326 - protein, 28 aa, Plasmodium falciparum
TFRNSTFFNAIRDMALSNPQRLPELLQM

SEQ ID NO: 3394327 - protein, 23 aa, Plasmodium falciparum
TFSKRIHRMIKLGLSIDEEENND

SEQ ID NO: 3394328 - protein, 30 aa, Plasmodium falciparum
TFSSYALFLLTYYFFQNINNPLLPSYKSIE

SEQ ID NO: 3394329 - protein, 30 aa, Plasmodium falciparum
TFTAQESAYLFMIIKFITFFSTNTLSSYKN

SEQ ID NO: 3394330 - protein, 22 aa, Plasmodium falciparum
TFTYMNELFLKEKFASTKNYSY

SEQ ID NO: 3394331 - protein, 17 aa, Plasmodium falciparum
TFYHSKYCEVCPGCGVK

SEQ ID NO: 3394332 - protein, 19 aa, Plasmodium falciparum
TFYKNLIKSKPSKFMEIIL

SEQ ID NO: 3394333 - protein, 19 aa, Plasmodium falciparum
TFYKQNIFPYFNNSKYSPF

SEQ ID NO: 3394334 - protein, 21 aa, Plasmodium falciparum
TFYNIDQFGLLNKKKKIKSLE

SEQ ID NO: 3394335 - protein, 43 aa, Plasmodium falciparum
TGAGFLLHNAILQYALNFLVNKKYIPVYPPFFMKKNIMEECAE

SEQ ID NO: 3394336 - protein, 25 aa, Plasmodium falciparum
TGAQLVDLYIDLVKKYPIVSIEDPF

SEQ ID NO: 3394337 - protein, 18 aa, Plasmodium falciparum
TGCDPLRIFLHEDGLVRF

SEQ ID NO: 3394338 - protein, 24 aa, Plasmodium falciparum
TGDAWPCVLLRKKSFEDLHKLYYI

SEQ ID NO: 3394339 - protein, 28 aa, Plasmodium falciparum
TGDIKNMEIFWFNKLTKNRQKSIIECYT

SEQ ID NO: 3394340 - protein, 24 aa, Plasmodium falciparum
TGDINKFEFLFLKASYADKHWTPP

SEQ ID NO: 3394341 - protein, 36 aa, Plasmodium falciparum
TGICSELFDAFKNASIPYVFINYNDLYNIADSQMHD

SEQ ID NO: 3394342 - protein, 18 aa, Plasmodium falciparum
TGIINFLRNKRLNKYSYD

SEQ ID NO: 3394343 - protein, 23 aa, Plasmodium falciparum
TGIRFSWNLWPPTKAEAAKIEVP

SEQ ID NO: 3394344 - protein, 41 aa, Plasmodium falciparum
TGKAFYYVYKEELIKYIYLYNLIKIKIIPYKSIIFTTTIHD

SEQ ID NO: 3394345 - protein, 23 aa, Plasmodium falciparum
TGKLRHQLIFRAYDLDRDGYLND

SEQ ID NO: 3394346 - protein, 41 aa, Plasmodium falciparum
TGKMKIYIEEIKKWLFIKAINIYKYFSFKKSIELIKKKDYF

SEQ ID NO: 3394347 - protein, 25 aa, Plasmodium falciparum
TGKSKGFGFIQFHKASEAIEALTVM

SEQ ID NO: 3394348 - protein, 25 aa, Plasmodium falciparum
TGKVKYLDFFIESYKNKIDIIKEQL

SEQ ID NO: 3394349 - protein, 28 aa, Plasmodium falciparum
TGLHNYRTFYLLIKINEIFNINKYKQIY

SEQ ID NO: 3394350 - protein, 30 aa, Plasmodium falciparum
TGLQYNTHLSALAWLCQLLIFEVECFNDIN

SEQ ID NO: 3394351 - protein, 27 aa, Plasmodium falciparum
TGMDKFTAKQLIRICLGGNMKASEYLK

SEQ ID NO: 3394352 - protein, 18 aa, Plasmodium falciparum
TGNLTVKLLPLAKKVITI

SEQ ID NO: 3394353 - protein, 24 aa, Plasmodium falciparum
TGPSLYFEILDYIPLHSLLFSGNC

SEQ ID NO: 3394354 - protein, 36 aa, Plasmodium falciparum
TGPVGANIFIFHIPNEWIQTDLLSAFSPFGNIISAH

SEQ ID NO: 3394355 - protein, 28 aa, Plasmodium falciparum
TGSGKTLSYLFPVIRHVLHQEPLRNNDG

SEQ ID NO: 3394356 - protein, 24 aa, Plasmodium falciparum
TGTALFFLLSKFTNLKKLAIIERR

SEQ ID NO: 3394357 - protein, 26 aa, Plasmodium falciparum
TGTPQIVTLLRFFFEKRLSMNDLENK

SEQ ID NO: 3394358 - protein, 23 aa, Plasmodium falciparum
TGTSRCIPFWSFCFRQNIKIKII

SEQ ID NO: 3394359 - protein, 20 aa, Plasmodium falciparum
TGYARYFALTLLRDHYKDNM

SEQ ID NO: 3394360 - protein, 21 aa, Plasmodium falciparum
TGYPYLPKKLKDFLIYFFRKN

SEQ ID NO: 3394361 - protein, 20 aa, Plasmodium falciparum
THDNLMFLKNIRSKSNNNLI

SEQ ID NO: 3394362 - protein, 37 aa, Plasmodium falciparum
THEDFNSDKYSLLTDLKLGHNLNLKSAYAISKLLSQK

SEQ ID NO: 3394363 - protein, 19 aa, Plasmodium falciparum
THETVIFGENLYKIVSKTL

SEQ ID NO: 3394364 - protein, 23 aa, Plasmodium falciparum
THFDYIWNEYTMQYFLSCYHDED

SEQ ID NO: 3394365 - protein, 18 aa, Plasmodium falciparum
THFLENDPNKRDEIISMI

SEQ ID NO: 3394366 - protein, 19 aa, Plasmodium falciparum
THFLNNFCKILLYNDIYSY

SEQ ID NO: 3394367 - protein, 17 aa, Plasmodium falciparum
THGNFMRQAFYSSNIKI

SEQ ID NO: 3394368 - protein, 43 aa, Plasmodium falciparum
THICMVFEFMGPNLLSLIKHYDYKGIPLNLVRKIATHVLIGMQ

SEQ ID NO: 3394369 - protein, 25 aa, Plasmodium falciparum
THIKNALYIFIKPPSTDVLLSRLLT

SEQ ID NO: 3394370 - protein, 34 aa, Plasmodium falciparum
THIKNEFVVYMQLPFKPFYIYNTSDIFRKRVIKQ

SEQ ID NO: 3394371 - protein, 18 aa, Plasmodium falciparum
THINNIFYSLKKKLKHNN

SEQ ID NO: 3394372 - protein, 20 aa, Plasmodium falciparum
THIPFPPLNYKHDTKLLILA

SEQ ID NO: 3394373 - protein, 19 aa, Plasmodium falciparum
THIYFSFNIIYQKIVKFQS

SEQ ID NO: 3394374 - protein, 18 aa, Plasmodium falciparum
THKFYFDNVGLPFLAFCF

SEQ ID NO: 3394375 - protein, 19 aa, Plasmodium falciparum
THKKKSIVLLFDTQNDIQY

SEQ ID NO: 3394376 - protein, 27 aa, Plasmodium falciparum
THLVKGLDFLLLNKVRNKLIDKISSEK

SEQ ID NO: 3394377 - protein, 19 aa, Plasmodium falciparum
THLVSLHNGLSVFLFGGSN

SEQ ID NO: 3394378 - protein, 29 aa, Plasmodium falciparum
THMKKVFIDLTLKLKYLRHLEYLKRKKKK

SEQ ID NO: 3394379 - protein, 20 aa, Plasmodium falciparum
THQPIEVLSLLRSTPNLNII

SEQ ID NO: 3394380 - protein, 27 aa, Plasmodium falciparum
THSHSLNQIILWNLPQLKKVTTLRGHK

SEQ ID NO: 3394381 - protein, 32 aa, Plasmodium falciparum
THSISLLYSFCTLQKWLFGAFANLVDNCVHAH

SEQ ID NO: 3394382 - protein, 19 aa, Plasmodium falciparum
THTTLLRKGKKNFKFIDET

SEQ ID NO: 3394383 - protein, 33 aa, Plasmodium falciparum
THVMKKLIKKYPNKIIYFLVYINDKETSIKRFA

SEQ ID NO: 3394384 - protein, 19 aa, Plasmodium falciparum
THVTLKSPSPLFVNQNMNV

SEQ ID NO: 3394385 - protein, 18 aa, Plasmodium falciparum
THWKQTLLHLYSNNYNIS

SEQ ID NO: 3394386 - protein, 17 aa, Plasmodium falciparum
THYSPFVSTYLLDIISC

SEQ ID NO: 3394387 - protein, 18 aa, Plasmodium falciparum
TIALLHLYGNLRNKFELD

SEQ ID NO: 3394388 - protein, 18 aa, Plasmodium falciparum
TICGIFLNNNAHLTILFS

SEQ ID NO: 3394389 - protein, 18 aa, Plasmodium falciparum
TICKFLNVILNTFHIKDY

SEQ ID NO: 3394390 - protein, 45 aa, Plasmodium falciparum
TIDEDKVLYSFPFKYFHLLVYAFKNYYFNIYLKKVHNNNDNNKIK

SEQ ID NO: 3394391 - protein, 20 aa, Plasmodium falciparum
TIDFNDFLDIMTIKMSERDP

SEQ ID NO: 3394392 - protein, 27 aa, Plasmodium falciparum
TIDLYNLFILYLNIKVDKYWAYSINDK

SEQ ID NO: 3394393 - protein, 26 aa, Plasmodium falciparum
TIDSPKMWLIKLFKNNVERNLAIGIY

SEQ ID NO: 3394394 - protein, 18 aa, Plasmodium falciparum
TIEFINFEKLPAGQNAIV

SEQ ID NO: 3394395 - protein, 23 aa, Plasmodium falciparum
TIEGFLHTALNNLTIYLKEIKNM

SEQ ID NO: 3394396 - protein, 20 aa, Plasmodium falciparum
TIERILTPRIALTTAEYLAF

SEQ ID NO: 3394397 - protein, 17 aa, Plasmodium falciparum
TIEVKLLNGISYKMCRS

SEQ ID NO: 3394398 - protein, 32 aa, Plasmodium falciparum
TIFEPINHYIYLLRLLPKFSLPLYDSGILQYV

SEQ ID NO: 3394399 - protein, 17 aa, Plasmodium falciparum
TIFIHYNDKKNIKKNNS

SEQ ID NO: 3394400 - protein, 17 aa, Plasmodium falciparum
TIFMKNIKLEKNMIYKI

SEQ ID NO: 3394401 - protein, 22 aa, Plasmodium falciparum
TIFYIIFILARNIQCTYKGDNI

SEQ ID NO: 3394402 - protein, 22 aa, Plasmodium falciparum
TIGCNLLKGLVPVQNLLNIKLS

SEQ ID NO: 3394403 - protein, 17 aa, Plasmodium falciparum
TIGLNSVIYIFKKTNMK

SEQ ID NO: 3394404 - protein, 29 aa, Plasmodium falciparum
TIHTPDHIIFDKIFNEQINFVQQLCETDF

SEQ ID NO: 3394405 - protein, 17 aa, Plasmodium falciparum
TIIKLKWDKFQPGILSS

SEQ ID NO: 3394406 - protein, 27 aa, Plasmodium falciparum
TIKKYKLPFEPNFYSNRFFFLDNDMNG

SEQ ID NO: 3394407 - protein, 24 aa, Plasmodium falciparum
TIKLWDLRFFDKCINTYLGHTNNI

SEQ ID NO: 3394408 - protein, 34 aa, Plasmodium falciparum
TIKNKGCVLIPVDLHFLYFIELIELIGVIISKHL

SEQ ID NO: 3394409 - protein, 29 aa, Plasmodium falciparum
TIKNSIKNGKSFITRYKNLFAKERNIVED

SEQ ID NO: 3394410 - protein, 17 aa, Plasmodium falciparum
TIKNYFFIKLPSISEPS

SEQ ID NO: 3394411 - protein, 24 aa, Plasmodium falciparum
TIKVKFMCNQNFGGVKFLDNNRKT

SEQ ID NO: 3394412 - protein, 19 aa, Plasmodium falciparum
TIKYILQDLRDNCLSNLAY

SEQ ID NO: 3394413 - protein, 27 aa, Plasmodium falciparum
TILCRKNCKNFILNKRINLEHYNSKKG

SEQ ID NO: 3394414 - protein, 18 aa, Plasmodium falciparum
TILGIISALIFYEKDQNV

SEQ ID NO: 3394415 - protein, 17 aa, Plasmodium falciparum
TILGVVAGLIPYPNHNQ

SEQ ID NO: 3394416 - protein, 20 aa, Plasmodium falciparum
TILKKIKIYEEDELYKGQYD

SEQ ID NO: 3394417 - protein, 24 aa, Plasmodium falciparum
TILNNTSMKKYFCRSRYSKLIEVE

SEQ ID NO: 3394418 - protein, 25 aa, Plasmodium falciparum
TILNVIIRNGFFIEGNYFICGSAYG

SEQ ID NO: 3394419 - protein, 21 aa, Plasmodium falciparum
TILSNILYQYKGYGLCCGIIL

SEQ ID NO: 3394420 - protein, 19 aa, Plasmodium falciparum
TILTDILLSSTFVTFCGGF

SEQ ID NO: 3394421 - protein, 19 aa, Plasmodium falciparum
TILYNRFYLKEIILEYDPR

SEQ ID NO: 3394422 - protein, 25 aa, Plasmodium falciparum
TINEKDKIIVHLNLQIKKLANQNEH

SEQ ID NO: 3394423 - protein, 35 aa, Plasmodium falciparum
TINIHKIHYNLYKDIYLLKTTYLRFIASASSKILN

SEQ ID NO: 3394424 - protein, 26 aa, Plasmodium falciparum
TINPRLIRHFFILNINFPENNTVNSI

SEQ ID NO: 3394425 - protein, 33 aa, Plasmodium falciparum
TINRLNKEWKSYVKCLILVSPMISLGKQKNKIS

SEQ ID NO: 3394426 - protein, 23 aa, Plasmodium falciparum
TINVIQLYDYDINLLSLAIHLLS

SEQ ID NO: 3394427 - protein, 18 aa, Plasmodium falciparum
TINYPYVMNIKKDSFLDN

SEQ ID NO: 3394428 - protein, 28 aa, Plasmodium falciparum
TIPTSQDIYFFSIFNWEWNFEGNTKHNY

SEQ ID NO: 3394429 - protein, 34 aa, Plasmodium falciparum
TIPVNGKQFFNFNNLYFLPNALNTFDNNIYSNNV

SEQ ID NO: 3394430 - protein, 24 aa, Plasmodium falciparum
TIQAITLILCQKLNKLKEIKKDER

SEQ ID NO: 3394431 - protein, 25 aa, Plasmodium falciparum
TIQEQFQMWLTGYQLTETFFVFLKN

SEQ ID NO: 3394432 - protein, 23 aa, Plasmodium falciparum
TIQTQLYKKYSPLKSRIGLRNSV

SEQ ID NO: 3394433 - protein, 25 aa, Plasmodium falciparum
TIQVQDFFKELWTFIQAVEFNRKTI

SEQ ID NO: 3394434 - protein, 20 aa, Plasmodium falciparum
TIRIICIVVYLEIYNKMNDT

SEQ ID NO: 3394435 - protein, 22 aa, Plasmodium falciparum
TIRLFSFQVIDILKKIFENNNK

SEQ ID NO: 3394436 - protein, 20 aa, Plasmodium falciparum
TISGLRFINVLNKKDKKKLG

SEQ ID NO: 3394437 - protein, 30 aa, Plasmodium falciparum
TISHVFINEMFFSFVLRIQQKYFNKGDSLN

SEQ ID NO: 3394438 - protein, 18 aa, Plasmodium falciparum
TISKIHARDLLKENKRKL

SEQ ID NO: 3394439 - protein, 20 aa, Plasmodium falciparum
TISLKEKLNFILETLNENFS

SEQ ID NO: 3394440 - protein, 26 aa, Plasmodium falciparum
TITELRHYMNKLLKYYKGGFNISTLK

SEQ ID NO: 3394441 - protein, 19 aa, Plasmodium falciparum
TITILRIDDLIKLVPEERK

SEQ ID NO: 3394442 - protein, 18 aa, Plasmodium falciparum
TITKEISIERLLHKIRNL

SEQ ID NO: 3394443 - protein, 22 aa, Plasmodium falciparum
TITRQIVLGGRNRYLLNSHNAK

SEQ ID NO: 3394444 - protein, 20 aa, Plasmodium falciparum
TITYGNYCTAIFDPDNNTKE

SEQ ID NO: 3394445 - protein, 25 aa, Plasmodium falciparum
TITYVNRVLIFLYADEASFQELQKK

SEQ ID NO: 3394446 - protein, 30 aa, Plasmodium falciparum
TIVCKYLECGKWFHIWDNMNTIIESKFCGN

SEQ ID NO: 3394447 - protein, 18 aa, Plasmodium falciparum
TIVKFSELILDLLPYINE

SEQ ID NO: 3394448 - protein, 32 aa, Plasmodium falciparum
TIYECNISNLVRFYYKYFPEKISNVRIDYLAN

SEQ ID NO: 3394449 - protein, 30 aa, Plasmodium falciparum
TIYMLPEPDPLPYLIYLFHQESGKVYSIEL

SEQ ID NO: 3394450 - protein, 18 aa, Plasmodium falciparum
TIYNHGYMRKFLSILRSV

SEQ ID NO: 3394451 - protein, 30 aa, Plasmodium falciparum
TIYTYNSIFQFLFLLSRIHYNLKILCYHNR

SEQ ID NO: 3394452 - protein, 20 aa, Plasmodium falciparum
TKALKNSIITLIKDINGNHV

SEQ ID NO: 3394453 - protein, 25 aa, Plasmodium falciparum
TKCRHIFCFFCILKYFIDEEKKIWK

SEQ ID NO: 3394454 - protein, 27 aa, Plasmodium falciparum
TKEDKTKLLIAYLKDKKKNKTQENNNT

SEQ ID NO: 3394455 - protein, 23 aa, Plasmodium falciparum
TKEFLMSVTYLEVYMERVNDLLQ

SEQ ID NO: 3394456 - protein, 20 aa, Plasmodium falciparum
TKEIFTSPSGKRRGGKYTID

SEQ ID NO: 3394457 - protein, 25 aa, Plasmodium falciparum
TKEKDLIFFPFNIKNNLLVQYHFNI

SEQ ID NO: 3394458 - protein, 29 aa, Plasmodium falciparum
TKEKKIYLKKILFTDLGIIGYPNVGKSTL

SEQ ID NO: 3394459 - protein, 17 aa, Plasmodium falciparum
TKESAMRLGWDYSFRHA

SEQ ID NO: 3394460 - protein, 18 aa, Plasmodium falciparum
TKEYLICEKTDGVRYFLF

SEQ ID NO: 3394461 - protein, 20 aa, Plasmodium falciparum
TKFYLLKEKFYKYKIFIEQA

SEQ ID NO: 3394462 - protein, 24 aa, Plasmodium falciparum
TKGDYFGELALLKNKPRAATIKAQ

SEQ ID NO: 3394463 - protein, 25 aa, Plasmodium falciparum
TKGFSLIHYSTLEEARKQCILYRCD

SEQ ID NO: 3394464 - protein, 17 aa, Plasmodium falciparum
TKGIAYTLLPWKENVTI

SEQ ID NO: 3394465 - protein, 31 aa, Plasmodium falciparum
TKGIFISFYEIYCGKLYDLLQKRKMVAALEN

SEQ ID NO: 3394466 - protein, 19 aa, Plasmodium falciparum
TKHKMFILEDQKMLNTRRG

SEQ ID NO: 3394467 - protein, 19 aa, Plasmodium falciparum
TKHNILFDVFKFPDCSKYN

SEQ ID NO: 3394468 - protein, 24 aa, Plasmodium falciparum
TKHNLIYIHELFSRSISMNSNIFP

SEQ ID NO: 3394469 - protein, 22 aa, Plasmodium falciparum
TKIEKCRIKLIRKFFCESSSEN

SEQ ID NO: 3394470 - protein, 26 aa, Plasmodium falciparum
TKIEKVYAYYPYYYKEPKKYRALGLD

SEQ ID NO: 3394471 - protein, 30 aa, Plasmodium falciparum
TKIIAQQLHTVLVLYLQILKEKKIEEKNIN

SEQ ID NO: 3394472 - protein, 17 aa, Plasmodium falciparum
TKIIQLEAACELAMWKE

SEQ ID NO: 3394473 - protein, 31 aa, Plasmodium falciparum
TKIMYMTDGMFLRLLLYNPTLEDISVLIIDE

SEQ ID NO: 3394474 - protein, 21 aa, Plasmodium falciparum
TKINLDDFIVLAPGLCEEPEN

SEQ ID NO: 3394475 - protein, 33 aa, Plasmodium falciparum
TKISFTIDFKIYPPILMKNITQLNIYIENKMIK

SEQ ID NO: 3394476 - protein, 33 aa, Plasmodium falciparum
TKKDDYSYYNYVQSILPFGILGNKGSNDSYSSN

SEQ ID NO: 3394477 - protein, 24 aa, Plasmodium falciparum
TKKDIYFKDIFKGEYFSKLLEIPE

SEQ ID NO: 3394478 - protein, 22 aa, Plasmodium falciparum
TKKFIDIYAYIDKYLYICGYVY

SEQ ID NO: 3394479 - protein, 25 aa, Plasmodium falciparum
TKKGNEYFLRNKKLFNYSCLENLIK

SEQ ID NO: 3394480 - protein, 28 aa, Plasmodium falciparum
TKKIKIKLIINKPPIYIKKKFISILFYF

SEQ ID NO: 3394481 - protein, 20 aa, Plasmodium falciparum
TKKKLLQYIKKKKKVKKNKC

SEQ ID NO: 3394482 - protein, 26 aa, Plasmodium falciparum
TKKKNIIIDYNPDIIYKNLDNLKSLY

SEQ ID NO: 3394483 - protein, 28 aa, Plasmodium falciparum
TKKKYTKLIYLLHCISYLIYSKEDKEKA

SEQ ID NO: 3394484 - protein, 24 aa, Plasmodium falciparum
TKKQNLILSWLTFKKNQTVNTLNE

SEQ ID NO: 3394485 - protein, 22 aa, Plasmodium falciparum
TKKRKWTDDAIFRNTCEKKEKK

SEQ ID NO: 3394486 - protein, 24 aa, Plasmodium falciparum
TKKRLITKYPKIIPSPLKDLFQYV

SEQ ID NO: 3394487 - protein, 31 aa, Plasmodium falciparum
TKKYIAFNHNKYVRFLNSCYEKKMNSVKKKI

SEQ ID NO: 3394488 - protein, 22 aa, Plasmodium falciparum
TKLDYQYLYYNLIYSNKKNTDT

SEQ ID NO: 3394489 - protein, 21 aa, Plasmodium falciparum
TKLSIKAFMLTLIGYNKPFDR

SEQ ID NO: 3394490 - protein, 24 aa, Plasmodium falciparum
TKMHKMNFFYLNDNKNITLSKNVD

SEQ ID NO: 3394491 - protein, 26 aa, Plasmodium falciparum
TKMIFNKILLILEKNYLKYLNIQNTY

SEQ ID NO: 3394492 - protein, 18 aa, Plasmodium falciparum
TKMKEQFLEDKPIDYLNT

SEQ ID NO: 3394493 - protein, 20 aa, Plasmodium falciparum
TKMQSLSDNLLNKVDNMEKY

SEQ ID NO: 3394494 - protein, 21 aa, Plasmodium falciparum
TKNAYLLFYQLISHKNEKFSG

SEQ ID NO: 3394495 - protein, 20 aa, Plasmodium falciparum
TKNCGVTLFGLLLSEVKNKN

SEQ ID NO: 3394496 - protein, 26 aa, Plasmodium falciparum
TKNEKFRHNCFYKNFDILNGNKRSDK

SEQ ID NO: 3394497 - protein, 27 aa, Plasmodium falciparum
TKNENLHDDYYYFKYLNNKENTTDPYH

SEQ ID NO: 3394498 - protein, 19 aa, Plasmodium falciparum
TKNFDIFLCLFMKYEKNES

SEQ ID NO: 3394499 - protein, 17 aa, Plasmodium falciparum
TKNFTNIIIPKYEIMHK

SEQ ID NO: 3394500 - protein, 24 aa, Plasmodium falciparum
TKNIWDLLSVKKQIYKSAIEAASM

SEQ ID NO: 3394501 - protein, 26 aa, Plasmodium falciparum
TKNMEGIMLDKYSDYFRKLNEISPNR

SEQ ID NO: 3394502 - protein, 29 aa, Plasmodium falciparum
TKNPEFLKYYNLLKDWDWCYGKTPKFQNH

SEQ ID NO: 3394503 - protein, 24 aa, Plasmodium falciparum
TKNQNYLYDIKKSKSLIPLNLMKN

SEQ ID NO: 3394504 - protein, 27 aa, Plasmodium falciparum
TKNVDGMKIIIDFQLVSPFQAEGENEA

SEQ ID NO: 3394505 - protein, 23 aa, Plasmodium falciparum
TKNYSYFLKRHKKIYFSSCLFLI

SEQ ID NO: 3394506 - protein, 35 aa, Plasmodium falciparum
TKNYYPHNMTFGQQQYFPYYNPLEQQNYQLHHIIK

SEQ ID NO: 3394507 - protein, 25 aa, Plasmodium falciparum
TKQCKRLLNGGCNFGLDRCQYSHNE

SEQ ID NO: 3394508 - protein, 25 aa, Plasmodium falciparum
TKQIKYLFHINNKGKGFFRIKKKGN

SEQ ID NO: 3394509 - protein, 31 aa, Plasmodium falciparum
TKQKFLYSFFKPYLLEYLKKIKNIPIFLSIE

SEQ ID NO: 3394510 - protein, 19 aa, Plasmodium falciparum
TKQKKIKYLLLYDNFCTNN

SEQ ID NO: 3394511 - protein, 24 aa, Plasmodium falciparum
TKQNFLDNFLFKRDSNEINKKLET

SEQ ID NO: 3394512 - protein, 22 aa, Plasmodium falciparum
TKQPIVIILKPSDTNKIECYLN

SEQ ID NO: 3394513 - protein, 26 aa, Plasmodium falciparum
TKQQELNLIITYYKNIIISIQKHINK

SEQ ID NO: 3394514 - protein, 33 aa, Plasmodium falciparum
TKRQSTVKKYLFDKLNWLKSYDNKDKKKNEKNQ

SEQ ID NO: 3394515 - protein, 25 aa, Plasmodium falciparum
TKSNYPQMIIPQKDGSFLIENVDPI

SEQ ID NO: 3394516 - protein, 34 aa, Plasmodium falciparum
TKSRRYINIISTLPKFFLDSILVNKHLYTHLYNN

SEQ ID NO: 3394517 - protein, 32 aa, Plasmodium falciparum
TKTFNGISYFLPPKILIEPEFSFTLTHLIKKI

SEQ ID NO: 3394518 - protein, 25 aa, Plasmodium falciparum
TKTINWWYDHPFKDLIYLYENGRVR

SEQ ID NO: 3394519 - protein, 28 aa, Plasmodium falciparum
TKTVSFSPTSVFNKPFDLNFEKNKEENK

SEQ ID NO: 3394520 - protein, 25 aa, Plasmodium falciparum
TKVGLFSHNILNVHKFFFNNRNGYE

SEQ ID NO: 3394521 - protein, 26 aa, Plasmodium falciparum
TKVIYPPEQLVFNAFLKTPLSNIKVV

SEQ ID NO: 3394522 - protein, 51 aa, Plasmodium falciparum
TKVKMKCECGWKTLIKEGNTWVRSEWSKKLLCLRLVKNPELLQKKYNIHSR

SEQ ID NO: 3394523 - protein, 19 aa, Plasmodium falciparum
TKVYGYRVEAIYDQTYNFL

SEQ ID NO: 3394524 - protein, 25 aa, Plasmodium falciparum
TKYSKPFKSKLLLLLNKLSDCSDIV

SEQ ID NO: 3394525 - protein, 23 aa, Plasmodium falciparum
TKYSYGFVNNKPLLPGHILLTTL

SEQ ID NO: 3394526 - protein, 33 aa, Plasmodium falciparum
TLCEIKRHYKINDCWIIANGYVYDVSTFINHHP

SEQ ID NO: 3394527 - protein, 21 aa, Plasmodium falciparum
TLCEKILNIRKLYFGDYNADK

SEQ ID NO: 3394528 - protein, 17 aa, Plasmodium falciparum
TLCMWVHALKMYAEVYR

SEQ ID NO: 3394529 - protein, 19 aa, Plasmodium falciparum
TLCYYNLSFSYIGLNDLNS

SEQ ID NO: 3394530 - protein, 19 aa, Plasmodium falciparum
TLDDILKFINSFLEDFKTL

SEQ ID NO: 3394531 - protein, 25 aa, Plasmodium falciparum
TLDDILKFIYSFLEHFKLLKKELYE

SEQ ID NO: 3394532 - protein, 23 aa, Plasmodium falciparum
TLDDVHHIFKYLYGNAKDLVEKN

SEQ ID NO: 3394533 - protein, 19 aa, Plasmodium falciparum
TLDGWYIKSFDLIQYNHYV

SEQ ID NO: 3394534 - protein, 17 aa, Plasmodium falciparum
TLDKIKLDNIYGSFIDD

SEQ ID NO: 3394535 - protein, 22 aa, Plasmodium falciparum
TLDLDKAMYRMKKFSEPISMYD

SEQ ID NO: 3394536 - protein, 17 aa, Plasmodium falciparum
TLDTKLIVSILTEKLKK

SEQ ID NO: 3394537 - protein, 20 aa, Plasmodium falciparum
TLDVPFFLKNVRHTGIEVFG

SEQ ID NO: 3394538 - protein, 27 aa, Plasmodium falciparum
TLECNMILDPLLLEEILWYIDNNKMYK

SEQ ID NO: 3394539 - protein, 20 aa, Plasmodium falciparum
TLEIYKMGKIQLEFELKCCK

SEQ ID NO: 3394540 - protein, 20 aa, Plasmodium falciparum
TLFEMSNIIKYNYIDKKLKF

SEQ ID NO: 3394541 - protein, 19 aa, Plasmodium falciparum
TLFHLLIRNGSIAIGLKER

SEQ ID NO: 3394542 - protein, 19 aa, Plasmodium falciparum
TLFLKFFEKTRYGYISLPD

SEQ ID NO: 3394543 - protein, 25 aa, Plasmodium falciparum
TLGPMAMLKMMLDPLGGIVITNDGN

SEQ ID NO: 3394544 - protein, 26 aa, Plasmodium falciparum
TLGSLEALLIFLNDSKIPVFGVNIGT

SEQ ID NO: 3394545 - protein, 29 aa, Plasmodium falciparum
TLHCLSNFFKWIPLTYIFDKYKFNDNNIQ

SEQ ID NO: 3394546 - protein, 26 aa, Plasmodium falciparum
TLIEQYWLHYYLCNNCFKLLQDKNIV

SEQ ID NO: 3394547 - protein, 21 aa, Plasmodium falciparum
TLILHFDNFTNLFECLKKFKY

SEQ ID NO: 3394548 - protein, 23 aa, Plasmodium falciparum
TLIQYPTFTHFLQNDTHISNYSN

SEQ ID NO: 3394549 - protein, 19 aa, Plasmodium falciparum
TLIRLHDQKEYFKLYQVIE

SEQ ID NO: 3394550 - protein, 23 aa, Plasmodium falciparum
TLIYCMEYLLINIDWLEEKLNTY

SEQ ID NO: 3394551 - protein, 19 aa, Plasmodium falciparum
TLIYRPPELIDLYSNFEIS

SEQ ID NO: 3394552 - protein, 18 aa, Plasmodium falciparum
TLKCLNLLYKKVKTDTQV

SEQ ID NO: 3394553 - protein, 26 aa, Plasmodium falciparum
TLKDDFIRYLLNNAHLYNNKLHMILS

SEQ ID NO: 3394554 - protein, 23 aa, Plasmodium falciparum
TLKDLIEMLFYLSLHIEFKKQLL

SEQ ID NO: 3394555 - protein, 31 aa, Plasmodium falciparum
TLKHIRWVDEIISPCPWVITPEFMEEHKIDY

SEQ ID NO: 3394556 - protein, 30 aa, Plasmodium falciparum
TLKHIRWVDEIISPCPWVVTPEFLEKYKID

SEQ ID NO: 3394557 - protein, 20 aa, Plasmodium falciparum
TLKIGFTKYKAKKIRCIQDF

SEQ ID NO: 3394558 - protein, 29 aa, Plasmodium falciparum
TLKINKEFKKIFKKLKYKNTVVISNIGKK

SEQ ID NO: 3394559 - protein, 34 aa, Plasmodium falciparum
TLKKHTPKVSLIKKWFGIYNLMSNGSTPDFIAVL

SEQ ID NO: 3394560 - protein, 21 aa, Plasmodium falciparum
TLKKIIRPKKKEKIVPIRINC

SEQ ID NO: 3394561 - protein, 25 aa, Plasmodium falciparum
TLKLEQLSFNDLKYFKKHGFSDKQI

SEQ ID NO: 3394562 - protein, 18 aa, Plasmodium falciparum
TLKLLKLMYEFFISNDDE

SEQ ID NO: 3394563 - protein, 23 aa, Plasmodium falciparum
TLKQSFEMIKNPSLMKELMKNTD

SEQ ID NO: 3394564 - protein, 27 aa, Plasmodium falciparum
TLLAGIHFLIPFIDKIAYVFSLKEETI

SEQ ID NO: 3394565 - protein, 22 aa, Plasmodium falciparum
TLLDIPGYYYDKKKNRYFLINN

SEQ ID NO: 3394566 - protein, 20 aa, Plasmodium falciparum
TLLELELRLLNDVAFIGIEN

SEQ ID NO: 3394567 - protein, 26 aa, Plasmodium falciparum
TLLHEMIHAFLFLTRSNRKHDGHGPE

SEQ ID NO: 3394568 - protein, 17 aa, Plasmodium falciparum
TLLHLYSNNYNISQIFN

SEQ ID NO: 3394569 - protein, 21 aa, Plasmodium falciparum
TLLLDLQILSLHQINLLFSIK

SEQ ID NO: 3394570 - protein, 19 aa, Plasmodium falciparum
TLLLKIASVESINILKKFE

SEQ ID NO: 3394571 - protein, 24 aa, Plasmodium falciparum
TLLNEPLDHFLGKPLNKFVDKPLD

SEQ ID NO: 3394572 - protein, 19 aa, Plasmodium falciparum
TLLSYPNSYLINGANNVSM

SEQ ID NO: 3394573 - protein, 18 aa, Plasmodium falciparum
TLMIDSLRRRYGKFIATV

SEQ ID NO: 3394574 - protein, 20 aa, Plasmodium falciparum
TLMVIGTLRKVKTGGILIVD

SEQ ID NO: 3394575 - protein, 29 aa, Plasmodium falciparum
TLNEAYFSRRILYSTTLLMDIRKTLSKKI

SEQ ID NO: 3394576 - protein, 23 aa, Plasmodium falciparum
TLNKNYIYVLKRSPELIVNCLKK

SEQ ID NO: 3394577 - protein, 18 aa, Plasmodium falciparum
TLNKPFIYGKLSPIERIA

SEQ ID NO: 3394578 - protein, 18 aa, Plasmodium falciparum
TLNTFPNAKGRFSLINKM

SEQ ID NO: 3394579 - protein, 19 aa, Plasmodium falciparum
TLNVLKKYQQTQKKSYFTL

SEQ ID NO: 3394580 - protein, 17 aa, Plasmodium falciparum
TLNYILQKYDDDDQFFC

SEQ ID NO: 3394581 - protein, 65 aa, Plasmodium falciparum
TLPILDNINHLLIKFSYPSKKALFYRCFAVSSCIIKNLRKKTFKILFEICKLKNLSYSIESIYNK

SEQ ID NO: 3394582 - protein, 21 aa, Plasmodium falciparum
TLPVYIYRMTMKQKNKYIPIK

SEQ ID NO: 3394583 - protein, 21 aa, Plasmodium falciparum
TLQMMVVIGELFRNIRKLRTK

SEQ ID NO: 3394584 - protein, 25 aa, Plasmodium falciparum
TLQSITVLYTLLKQGFHKKCAVRRC

SEQ ID NO: 3394585 - protein, 22 aa, Plasmodium falciparum
TLRHDNYFRKRKRTHLKGKYVL

SEQ ID NO: 3394586 - protein, 18 aa, Plasmodium falciparum
TLRMKDLLVTKYKFYDSS

SEQ ID NO: 3394587 - protein, 25 aa, Plasmodium falciparum
TLSHYVLMQRLFPSTFTAIHCRTQE

SEQ ID NO: 3394588 - protein, 30 aa, Plasmodium falciparum
TLSKIPYSKYDVIRKPLDLNKGGKGTFRYL

SEQ ID NO: 3394589 - protein, 32 aa, Plasmodium falciparum
TLSKVLYKKFKLIQKIYNSCYIINNKNGIYYK

SEQ ID NO: 3394590 - protein, 26 aa, Plasmodium falciparum
TLSNKQIIMLLRQLKEPIRLFGETDL

SEQ ID NO: 3394591 - protein, 23 aa, Plasmodium falciparum
TLSNYMQFFVFKSGNLVIKQGEK

SEQ ID NO: 3394592 - protein, 30 aa, Plasmodium falciparum
TLSSLALVFALHYFKPNPIYFMDEIDAALD

SEQ ID NO: 3394593 - protein, 33 aa, Plasmodium falciparum; identical to SEQ ID NO: 3373367

SEQ ID NO: 3394594 - protein, 17 aa, Plasmodium falciparum
TLTKFKKYKSISIFIEN

SEQ ID NO: 3394595 - protein, 45 aa, Plasmodium falciparum
TLYDIVKVIYYNYRNFKYTEKLKFYITTFLNFSKIEKAKLEFMEK

SEQ ID NO: 3394596 - protein, 23 aa, Plasmodium falciparum
TLYKDPVYILKKFLERDRNILKY

SEQ ID NO: 3394597 - protein, 28 aa, Plasmodium falciparum
TLYNEALKIFKTKKSLWLALANLELTHG

SEQ ID NO: 3394598 - protein, 17 aa, Plasmodium falciparum
TLYVIILEINKFKHAYP

SEQ ID NO: 3394599 - protein, 21 aa, Plasmodium falciparum
TMDMYKIGKPFYDIDKRAHLK

SEQ ID NO: 3394600 - protein, 23 aa, Plasmodium falciparum
TMDSIHFDSIHIDSLHIDNLHID

SEQ ID NO: 3394601 - protein, 23 aa, Plasmodium falciparum
TMFKNKIIYIKNTDIFIINLQNV

SEQ ID NO: 3394602 - protein, 20 aa, Plasmodium falciparum
TMKFYHNEYLYNYRHKDNRK

SEQ ID NO: 3394603 - protein, 18 aa, Plasmodium falciparum
TMKNKKKNYYRYQNNYKN

SEQ ID NO: 3394604 - protein, 19 aa, Plasmodium falciparum
TMNPTYPSLPKFPNYNLNS

SEQ ID NO: 3394605 - protein, 19 aa, Plasmodium falciparum
TMNQPFNHPALYNNTNKPL

SEQ ID NO: 3394606 - protein, 37 aa, Plasmodium falciparum
TMPMDNVKFFPYLQFSYSLNYNISPYVYNKLIISKNP

SEQ ID NO: 3394607 - protein, 26 aa, Plasmodium falciparum
TMSEKYEIYLYTMGTLEHAKSCLFLL

SEQ ID NO: 3394608 - protein, 23 aa, Plasmodium falciparum
TMSKFNFVPKIKKIFSFKEKNKC

SEQ ID NO: 3394609 - protein, 17 aa, Plasmodium falciparum
TMTSNGLLYNNMNIINN

SEQ ID NO: 3394610 - protein, 20 aa, Plasmodium falciparum
TMVLSLKNLSKNKWSSLSKK

SEQ ID NO: 3394611 - protein, 27 aa, Plasmodium falciparum
TNAFKNILNILPNNKLKFIQLSNGNPI

SEQ ID NO: 3394612 - protein, 25 aa, Plasmodium falciparum
TNAKSRFWYFMKKINKLKKSNGELL

SEQ ID NO: 3394613 - protein, 27 aa, Plasmodium falciparum
TNANSNIFFFLKTIFILISLDDHKENK

SEQ ID NO: 3394614 - protein, 25 aa, Plasmodium falciparum
TNANYKFFKVIFINVPLNVQDNEEN

SEQ ID NO: 3394615 - protein, 24 aa, Plasmodium falciparum
TNAPKGILNEYKLVKNVRSNSNSL

SEQ ID NO: 3394616 - protein, 54 aa, Plasmodium falciparum
TNAYLTEQCIVNELQIDIGKGWKHFMIYDGKLRELILRKNLTNEDKLRMAVHMQ

SEQ ID NO: 3394617 - protein, 19 aa, Plasmodium falciparum
TNCKYALLGILKVSKYTKK

SEQ ID NO: 3394618 - protein, 21 aa, Plasmodium falciparum
TNCNILLKEITTRNYLNFSTL

SEQ ID NO: 3394619 - protein, 17 aa, Plasmodium falciparum
TNCWVAFYRSNNFPVCR

SEQ ID NO: 3394620 - protein, 24 aa, Plasmodium falciparum
TNDDATYFAFKNKDNLIHDEGMCE

SEQ ID NO: 3394621 - protein, 36 aa, Plasmodium falciparum
TNDHTNNFFIPKIDNLIYILNKMLQVFKLNEQNILD

SEQ ID NO: 3394622 - protein, 23 aa, Plasmodium falciparum
TNDIIEYMLIPQWYMNCSELAHQ

SEQ ID NO: 3394623 - protein, 25 aa, Plasmodium falciparum
TNDNGIIILSSIYPFIHSYDYNQKL

SEQ ID NO: 3394624 - protein, 50 aa, Plasmodium falciparum
TNDNLINILSPNYVDPAPPIVLKNQQVLPQLYIRQPPTVIVTNEPRPPLV

SEQ ID NO: 3394625 - protein, 32 aa, Plasmodium falciparum
TNDTSEIPFVRRATRTLTFKNQGGLTGCLKTV

SEQ ID NO: 3394626 - protein, 26 aa, Plasmodium falciparum
TNDYYYIIHLEWFNKLKKFINNESND

SEQ ID NO: 3394627 - protein, 24 aa, Plasmodium falciparum
TNEEFITNLFFTPDNKYIIISTNH

SEQ ID NO: 3394628 - protein, 28 aa, Plasmodium falciparum
TNEEKNEIFYFLLKKIITSFEKKKKGNI

SEQ ID NO: 3394629 - protein, 24 aa, Plasmodium falciparum
TNEELYILIKRSSNKLRALFEMCF

SEQ ID NO: 3394630 - protein, 18 aa, Plasmodium falciparum
TNEKVIPSYYTNLVKKYK

SEQ ID NO: 3394631 - protein, 24 aa, Plasmodium falciparum
TNENIQMNNLIYNMSKMSLNNINS

SEQ ID NO: 3394632 - protein, 17 aa, Plasmodium falciparum
TNENIYQFIGKKKKNYS

SEQ ID NO: 3394633 - protein, 28 aa, Plasmodium falciparum
TNENSSTIVRILKLAPQKVVRWDENTID

SEQ ID NO: 3394634 - protein, 31 aa, Plasmodium falciparum
TNEQVLIDLPKNHLLNKLTTSIIHSINPHLI

SEQ ID NO: 3394635 - protein, 54 aa, Plasmodium falciparum
TNESEEVTGYILPGFKGKHMVGFTCFLKRGTQNPVPPPPAPPLTNNQGENNIPT

SEQ ID NO: 3394636 - protein, 23 aa, Plasmodium falciparum
TNEYYDYFVTDKTLLGGKGKFHN

SEQ ID NO: 3394637 - protein, 21 aa, Plasmodium falciparum
TNFLCLEEILKNINLILKKQI

SEQ ID NO: 3394638 - protein, 34 aa, Plasmodium falciparum
TNFSCILEVELWYHSFILLKLDFNKSDPFIQLNA

SEQ ID NO: 3394639 - protein, 23 aa, Plasmodium falciparum
TNFSYLHVLGFQKYDDMSGNDLN

SEQ ID NO: 3394640 - protein, 19 aa, Plasmodium falciparum
TNFYHEMMRIPKMKGVHFD

SEQ ID NO: 3394641 - protein, 25 aa, Plasmodium falciparum
TNGSQFFITYSRQPHLNGIYPVFGK

SEQ ID NO: 3394642 - protein, 21 aa, Plasmodium falciparum
TNGVAFLPRDIKKVAYNTNEN

SEQ ID NO: 3394643 - protein, 20 aa, Plasmodium falciparum
TNHFINYNFICSKIGIKREF

SEQ ID NO: 3394644 - protein, 23 aa, Plasmodium falciparum
TNHTLFITKFYKKLTNFIEFYRS

SEQ ID NO: 3394645 - protein, 46 aa, Plasmodium falciparum
TNIDETWPTFFFVNLNFSKFNNVYRLLYIWMKLIEIKDTTNEATCD

SEQ ID NO: 3394646 - protein, 23 aa, Plasmodium falciparum
TNIKNIFYMLAEEIYKNIINNNN

SEQ ID NO: 3394647 - protein, 22 aa, Plasmodium falciparum
TNINRKFLWKGMKILLSAKFAQ

SEQ ID NO: 3394648 - protein, 41 aa, Plasmodium falciparum
TNKIHANYLLGNPVNLFWLGGPLPGLTILHNMKKYSKNVVV

SEQ ID NO: 3394649 - protein, 43 aa, Plasmodium falciparum
TNKLDSLLLCSLRFYLNMFYLSTPRYFMFKKYNFVLKQINQIQ

SEQ ID NO: 3394650 - protein, 23 aa, Plasmodium falciparum
TNKNFRLFLTMEFNPRIPQSLMR

SEQ ID NO: 3394651 - protein, 17 aa, Plasmodium falciparum
TNKNILNFIKPDDMYIN

SEQ ID NO: 3394652 - protein, 22 aa, Plasmodium falciparum
TNKYLLMQKNVNDIINFNIAKN

SEQ ID NO: 3394653 - protein, 23 aa, Plasmodium falciparum
TNLCLDYVPLILQAIKLFNERKM

SEQ ID NO: 3394654 - protein, 27 aa, Plasmodium falciparum
TNLDYVPQYLRWFDEWGEEFCRKRKIK

SEQ ID NO: 3394655 - protein, 19 aa, Plasmodium falciparum
TNLIIDDIILFYKSYVNQD

SEQ ID NO: 3394656 - protein, 19 aa, Plasmodium falciparum
TNLKLLKDSNWMNYKKNVN

SEQ ID NO: 3394657 - protein, 19 aa, Plasmodium falciparum
TNLNSLFYITQPISKRMIN

SEQ ID NO: 3394658 - protein, 19 aa, Plasmodium falciparum
TNLWGDTKLLFNKKVHRYI

SEQ ID NO: 3394659 - protein, 26 aa, Plasmodium falciparum
TNMENNYFDIPKRESLFNKNSSFSKE

SEQ ID NO: 3394660 - protein, 17 aa, Plasmodium falciparum
TNMPILYSMNKEQYINI

SEQ ID NO: 3394661 - protein, 17 aa, Plasmodium falciparum
TNNENYNKIYYQNSYYI

SEQ ID NO: 3394662 - protein, 24 aa, Plasmodium falciparum
TNNEQILKYIPNKISKRNMEFKLI

SEQ ID NO: 3394663 - protein, 25 aa, Plasmodium falciparum
TNNIPQPFSFDKGQYKVKIKPVFFE

SEQ ID NO: 3394664 - protein, 32 aa, Plasmodium falciparum
TNNKYHIIPESLYIPNLLTNSLKYSKELVDKY

SEQ ID NO: 3394665 - protein, 18 aa, Plasmodium falciparum
TNNLVNPINYKKVSSKKR

SEQ ID NO: 3394666 - protein, 23 aa, Plasmodium falciparum
TNNNYFVHYSKNIHFQNYKCNFI

SEQ ID NO: 3394667 - protein, 22 aa, Plasmodium falciparum
TNNRKPVSATKPSNNGPVRSNP

SEQ ID NO: 3394668 - protein, 29 aa, Plasmodium falciparum
TNNSNNFLLKYDSLKKSGMNINMLSCDEK

SEQ ID NO: 3394669 - protein, 27 aa, Plasmodium falciparum
TNNYSKYFIPRIPFKYNKLVDLEYDLI

SEQ ID NO: 3394670 - protein, 26 aa, Plasmodium falciparum
TNPIVCFVHFRFTPDYYPYQKNIICY

SEQ ID NO: 3394671 - protein, 27 aa, Plasmodium falciparum
TNPQNQFTIMTWNVLAEIYGTIEAFPH

SEQ ID NO: 3394672 - protein, 26 aa, Plasmodium falciparum
TNPSVAHIFLIRYVNSMPLFGNTGND

SEQ ID NO: 3394673 - protein, 27 aa, Plasmodium falciparum
TNQKENYYEWMLPTIYNKDDDIQSDQL

SEQ ID NO: 3394674 - protein, 17 aa, Plasmodium falciparum
TNQVFLIRCREKNRTVV

SEQ ID NO: 3394675 - protein, 25 aa, Plasmodium falciparum
TNRRYAETFLYLTNGYNLDIEQIIK

SEQ ID NO: 3394676 - protein, 26 aa, Plasmodium falciparum
TNSDIYFFHYILIQNIFQLYNERKKI

SEQ ID NO: 3394677 - protein, 26 aa, Plasmodium falciparum
TNSNKHIPYMLNRANPFIQPNYSNKK

SEQ ID NO: 3394678 - protein, 31 aa, Plasmodium falciparum
TNSSSYYNILENFYKRRLQRLQNARNRMYID

SEQ ID NO: 3394679 - protein, 24 aa, Plasmodium falciparum
TNTNINLLKPSIRKMYGPPEGSTC

SEQ ID NO: 3394680 - protein, 26 aa, Plasmodium falciparum
TNTNLYLLINTLTNVSLKYLKNDSKV

SEQ ID NO: 3394681 - protein, 24 aa, Plasmodium falciparum
TNTVNIFYLDKVNKRKIPKIKFKT

SEQ ID NO: 3394682 - protein, 19 aa, Plasmodium falciparum
TNVAIVKYKYKGKKFEIAC

SEQ ID NO: 3394683 - protein, 23 aa, Plasmodium falciparum
TNVFTCLLCIVNSKFPNIGLLTI

SEQ ID NO: 3394684 - protein, 29 aa, Plasmodium falciparum
TNVLNIPNYIKFFSFKYFNPIQTQMFHAT

SEQ ID NO: 3394685 - protein, 26 aa, Plasmodium falciparum
TNVSKSLYHIFFEDSIFYDYNLKNYS

SEQ ID NO: 3394686 - protein, 25 aa, Plasmodium falciparum
TNVTNIKLYHPKWYNKKKIIERLKE

SEQ ID NO: 3394687 - protein, 27 aa, Plasmodium falciparum
TNVYLEEYFLNIFRILKDHNLNLHFDN

SEQ ID NO: 3394688 - protein, 30 aa, Plasmodium falciparum
TNYCYSYEALFWILSQRYLYDYILFIIPSD

SEQ ID NO: 3394689 - protein, 21 aa, Plasmodium falciparum
TNYDTFFYNNFKKNIKNEKYN

SEQ ID NO: 3394690 - protein, 25 aa, Plasmodium falciparum
TNYEKNFNFTLNMMKMLFSNTNNNE

SEQ ID NO: 3394691 - protein, 23 aa, Plasmodium falciparum
TNYIPEHLIIINSLNSGSEGLLL

SEQ ID NO: 3394692 - protein, 29 aa, Plasmodium falciparum
TNYIPLFHTHILSPYLNLAFTLVENYYKD

SEQ ID NO: 3394693 - protein, 47 aa, Plasmodium falciparum
TNYQQIFDFSFLNNNFLFIYYKSFFKNKIYHLFKEKNSFYYLQNLDT

SEQ ID NO: 3394694 - protein, 30 aa, Plasmodium falciparum
TPAGVYMIRINGVVQAWRAEWRSPSGCKRT

SEQ ID NO: 3394695 - protein, 20 aa, Plasmodium falciparum
TPCIFINTLLSPEQFRNLEF

SEQ ID NO: 3394696 - protein, 29 aa, Plasmodium falciparum
TPCSWNYLCINKTWPIFNPCGMYICRLHC

SEQ ID NO: 3394697 - protein, 20 aa, Plasmodium falciparum
TPCTFFITASIDKKINYKEK

SEQ ID NO: 3394698 - protein, 35 aa, Plasmodium falciparum
TPDKERLIKINLTFPIFFIICKSDGYEILNNRTYQ

SEQ ID NO: 3394699 - protein, 31 aa, Plasmodium falciparum
TPDKWKEDMFRFFNIPLRSSISVRDLRIERA

SEQ ID NO: 3394700 - protein, 17 aa, Plasmodium falciparum
TPDNRYSHILPCDILPH

SEQ ID NO: 3394701 - protein, 29 aa, Plasmodium falciparum
TPEDVLHSFFLMKYIYNYKFIDIEESIFK

SEQ ID NO: 3394702 - protein, 25 aa, Plasmodium falciparum
TPEELKEILIPISGVYYSSSDEKWI

SEQ ID NO: 3394703 - protein, 21 aa, Plasmodium falciparum
TPHTYLLFKNDENKAYLEMVK

SEQ ID NO: 3394704 - protein, 20 aa, Plasmodium falciparum
TPHYYRNKINTFKNFNKSCD

SEQ ID NO: 3394705 - protein, 23 aa, Plasmodium falciparum
TPIKKLYLKYRSNSLSWNNMNPK

SEQ ID NO: 3394706 - protein, 48 aa, Plasmodium falciparum
TPLEETVIACYAYQIIDLLEYMHTNFIIFQGLLSNIILLQKNTKEELV

SEQ ID NO: 3394707 - protein, 17 aa, Plasmodium falciparum
TPLFSFTNKLHNSVSNN

SEQ ID NO: 3394708 - protein, 23 aa, Plasmodium falciparum
TPLKYINYIVTEVGLYTSSNKNA

SEQ ID NO: 3394709 - protein, 23 aa, Plasmodium falciparum
TPLRLANSIGLIDAGYRGEIIAA

SEQ ID NO: 3394710 - protein, 22 aa, Plasmodium falciparum
TPLTEKCFYSCLISLDNFYVNA

SEQ ID NO: 3394711 - protein, 22 aa, Plasmodium falciparum
TPMKYYMDTLNYFDNKNMLDMH

SEQ ID NO: 3394712 - protein, 21 aa, Plasmodium falciparum
TPNLPIRRYKTKKFNLEKSMN

SEQ ID NO: 3394713 - protein, 26 aa, Plasmodium falciparum
TPNNNKIFFYNVHLINDDDLFKRRKN

SEQ ID NO: 3394714 - protein, 23 aa, Plasmodium falciparum
TPSTDFFSRAVGYNNNYLNNNNN

SEQ ID NO: 3394715 - protein, 29 aa, Plasmodium falciparum
TPTDVKRNIFFDDLILISSSYNQHFFPNL

SEQ ID NO: 3394716 - protein, 22 aa, Plasmodium falciparum
TPTPILCENNCGFYGNPANNNL

SEQ ID NO: 3394717 - protein, 20 aa, Plasmodium falciparum
TPVNAYLDLFITLLEMGKDK

SEQ ID NO: 3394718 - protein, 18 aa, Plasmodium falciparum
TPWSLDSGFRRRFEKRIY

SEQ ID NO: 3394719 - protein, 21 aa, Plasmodium falciparum
TPYFVQRYKLFKKMNFKVLFL

SEQ ID NO: 3394720 - protein, 24 aa, Plasmodium falciparum
TQALNLFRNILYHMIFVETNESEQ

SEQ ID NO: 3394721 - protein, 31 aa, Plasmodium falciparum
TQHIKGVKRTNFPWIHSNRIKNILNYNYIHP

SEQ ID NO: 3394722 - protein, 32 aa, Plasmodium falciparum
TQHYSQPIYFEPLPPIYVKNQLLPSPILVQMP

SEQ ID NO: 3394723 - protein, 40 aa, Plasmodium falciparum
TQIVESIFSCNLKFPDFVNPLAIDLIKKTLVVDVNKRIRL

SEQ ID NO: 3394724 - protein, 17 aa, Plasmodium falciparum
TQKHIIQAIKIIPRSVT

SEQ ID NO: 3394725 - protein, 24 aa, Plasmodium falciparum
TQKKFLIKYHIYPTDMELISEADN

SEQ ID NO: 3394726 - protein, 25 aa, Plasmodium falciparum
TQKKKKWYHFPSTSKFRNLENVEPM

SEQ ID NO: 3394727 - protein, 26 aa, Plasmodium falciparum
TQKKKNFNYLLEKAVNNIIYETKKNC

SEQ ID NO: 3394728 - protein, 40 aa, Plasmodium falciparum
TQKKLYELMKRKIIIIQRWFRNRLNIIRKEKLKRQEAEKL

SEQ ID NO: 3394729 - protein, 17 aa, Plasmodium falciparum
TQKNDVLVIFKKIIEYI

SEQ ID NO: 3394730 - protein, 28 aa, Plasmodium falciparum
TQLISLMSIPMKVQLFHYIKYINNDNKI

SEQ ID NO: 3394731 - protein, 27 aa, Plasmodium falciparum
TQLLNHIRAIKLILQKLKHNDKQRLID

SEQ ID NO: 3394732 - protein, 17 aa, Plasmodium falciparum
TQLTQYLYECKYHMYGN

SEQ ID NO: 3394733 - protein, 25 aa, Plasmodium falciparum
TQNEKGALTIIRLPAENKKQNMNVK

SEQ ID NO: 3394734 - protein, 25 aa, Plasmodium falciparum
TQNEKGALTIIRLPAENKKQVKKKK

SEQ ID NO: 3394735 - protein, 17 aa, Plasmodium falciparum
TQNFRLLKKLTDDLKRI

SEQ ID NO: 3394736 - protein, 23 aa, Plasmodium falciparum
TQNGKFFYDLNGVKYKALVSYAP

SEQ ID NO: 3394737 - protein, 34 aa, Plasmodium falciparum
TQNSVGVSSLIPYLKLFSTEILNNVLPSAQSLEI

SEQ ID NO: 3394738 - protein, 25 aa, Plasmodium falciparum
TQNTLSNNYLLYRYKYNIEKEYVIK

SEQ ID NO: 3394739 - protein, 26 aa, Plasmodium falciparum
TQQDVNLFFIFILRTNQLNEAKDLLK

SEQ ID NO: 3394740 - protein, 33 aa, Plasmodium falciparum
TQRSRYCMDDNSPINYFGIAFNNRKEFTIRDYM

SEQ ID NO: 3394741 - protein, 17 aa, Plasmodium falciparum
TQYGHFPYNFFKNNEQG

SEQ ID NO: 3394742 - protein, 25 aa, Plasmodium falciparum
TQYRKQVLKGFTFNISLLSDDIKRS

SEQ ID NO: 3394743 - protein, 20 aa, Plasmodium falciparum
TRADVFREMYNWCKFQLEMK

SEQ ID NO: 3394744 - protein, 18 aa, Plasmodium falciparum
TRAHSFFRRANIYFNNKT

SEQ ID NO: 3394745 - protein, 25 aa, Plasmodium falciparum
TRDDKILYIYALNLSKSLLQKNEQL

SEQ ID NO: 3394746 - protein, 21 aa, Plasmodium falciparum
TRDLTKLSGYIWMRSLLCYTS

SEQ ID NO: 3394747 - protein, 23 aa, Plasmodium falciparum
TRDYRYMWQYNFRGKYERPRGQH

SEQ ID NO: 3394748 - protein, 23 aa, Plasmodium falciparum
TREALMCLSLCHYVQNPLGVVIS

SEQ ID NO: 3394749 - protein, 24 aa, Plasmodium falciparum
TRENYIYSILNDIISKNISIKAIE

SEQ ID NO: 3394750 - protein, 27 aa, Plasmodium falciparum
TRHPIRLYCRYVDKIWILFKFTNEESK

SEQ ID NO: 3394751 - protein, 25 aa, Plasmodium falciparum
TRIDRVLRLPLGHLLLVGASGAGKT

SEQ ID NO: 3394752 - protein, 23 aa, Plasmodium falciparum
TRKYIQMIKRLLSFCQRKYCTNP

SEQ ID NO: 3394753 - protein, 19 aa, Plasmodium falciparum
TRLKMMNIFNYKKKRKEIK

SEQ ID NO: 3394754 - protein, 27 aa, Plasmodium falciparum
TRMTNDYYYNYLFCNIQGVIAYSRFHK

SEQ ID NO: 3394755 - protein, 27 aa, Plasmodium falciparum
TRNAIGFYFNDMWILNINLINEDNISV

SEQ ID NO: 3394756 - protein, 26 aa, Plasmodium falciparum
TRNLKEYLYMNMPKDKNPLNYSKKKK

SEQ ID NO: 3394757 - protein, 27 aa, Plasmodium falciparum
TRNLQILYLYIVLFHSSIYNNLTLEQR

SEQ ID NO: 3394758 - protein, 19 aa, Plasmodium falciparum
TRNLYKKNLLYFHEKYNEK

SEQ ID NO: 3394759 - protein, 22 aa, Plasmodium falciparum
TRQAFWPCVDKYPWHTHQKRWV

SEQ ID NO: 3394760 - protein, 31 aa, Plasmodium falciparum
TRRRSDFNGINLKPFVRYKSLSILEKEKNKN

SEQ ID NO: 3394761 - protein, 17 aa, Plasmodium falciparum
TRVYYNKECELVEKNVY

SEQ ID NO: 3394762 - protein, 20 aa, Plasmodium falciparum
TSAKTKFFLIKSSSDKNIAI

SEQ ID NO: 3394763 - protein, 17 aa, Plasmodium falciparum
TSCKSSRELIICQKSHS

SEQ ID NO: 3394764 - protein, 27 aa, Plasmodium falciparum
TSDDKKIFIWEYGLPVVVKYISDASMF

SEQ ID NO: 3394765 - protein, 25 aa, Plasmodium falciparum
TSDQLIQYVLFHKAIDTTIILYNLL

SEQ ID NO: 3394766 - protein, 22 aa, Plasmodium falciparum
TSDSFISIYGYLIKNRRSKNIK

SEQ ID NO: 3394767 - protein, 24 aa, Plasmodium falciparum
TSECFEYLEISPPAFIDPQNNNIQ

SEQ ID NO: 3394768 - protein, 26 aa, Plasmodium falciparum
TSEKDILHNFLEKIYNVNPLSNYIKN

SEQ ID NO: 3394769 - protein, 25 aa, Plasmodium falciparum
TSEKLNCITGITEVPIPLEIKMKNI

SEQ ID NO: 3394770 - protein, 57 aa, Plasmodium falciparum
TSENTLPLYIILDCSAVLDMKELWKDKSILPFSFPGLLYLYNNKLLKANTIGNNNIH

SEQ ID NO: 3394771 - protein, 32 aa, Plasmodium falciparum
TSETIMYSVFPKWIRSYRDLPLKLNQWNTVVR

SEQ ID NO: 3394772 - protein, 22 aa, Plasmodium falciparum
TSFFKYCFDRLKSLLNNLQIVN

SEQ ID NO: 3394773 - protein, 19 aa, Plasmodium falciparum
TSFFVSHHLPMTVCSYSDH

SEQ ID NO: 3394774 - protein, 18 aa, Plasmodium falciparum
TSFFYIPDKLRKESEPYL

SEQ ID NO: 3394775 - protein, 27 aa, Plasmodium falciparum
TSFHEFFELWVKNLLKDTMKWENEIKD

SEQ ID NO: 3394776 - protein, 18 aa, Plasmodium falciparum
TSGFLELIKQKYGSWDVS

SEQ ID NO: 3394777 - protein, 28 aa, Plasmodium falciparum
TSGQLSPLLLYFSVLLEYDKLNTYESIE

SEQ ID NO: 3394778 - protein, 21 aa, Plasmodium falciparum
TSHFTNILTFMIFTILHKANT

SEQ ID NO: 3394779 - protein, 48 aa, Plasmodium falciparum
TSHIPIIEILSNDFFLFPFKLLHRLKKAILILKYIMHICPIYLYEVKN

SEQ ID NO: 3394780 - protein, 26 aa, Plasmodium falciparum
TSHLRNEYLNYYGRPIWAHKKDEVHD

SEQ ID NO: 3394781 - protein, 25 aa, Plasmodium falciparum
TSIHMLFVCLLYTCNDQELLLEKIP

SEQ ID NO: 3394782 - protein, 28 aa, Plasmodium falciparum
TSIIKNLDIPLLIKKQLNLRDLRRKNKD

SEQ ID NO: 3394783 - protein, 17 aa, Plasmodium falciparum
TSILFIHDYSYQSLCYD

SEQ ID NO: 3394784 - protein, 26 aa, Plasmodium falciparum
TSIQKMSIPLFFKPNDIFLKSMTGSG

SEQ ID NO: 3394785 - protein, 29 aa, Plasmodium falciparum
TSIQSKTFKKVLMICAQKGFSKPPHNINF

SEQ ID NO: 3394786 - protein, 24 aa, Plasmodium falciparum
TSISKLFQLYNFSKSRPTVLIKNL

SEQ ID NO: 3394787 - protein, 33 aa, Plasmodium falciparum
TSKEFNFKEFYFGKLTIVPLLNIKKFNEFNYPN

SEQ ID NO: 3394788 - protein, 29 aa, Plasmodium falciparum
TSKEKIINVCLWGISPFTYGKIEKDFALI

SEQ ID NO: 3394789 - protein, 28 aa, Plasmodium falciparum
TSKFESSVLFKILVFRGIPNENFDDLLK

SEQ ID NO: 3394790 - protein, 25 aa, Plasmodium falciparum
TSKFETLRICKLLNISSLIKLSTPQ

SEQ ID NO: 3394791 - protein, 25 aa, Plasmodium falciparum
TSKGVHLISFADKKYLKLGRGHESD

SEQ ID NO: 3394792 - protein, 17 aa, Plasmodium falciparum
TSKLYCISNFAKSLLDV

SEQ ID NO: 3394793 - protein, 30 aa, Plasmodium falciparum
TSKNKKFIKFPSCNLFNNKLNDFINNSFGD

SEQ ID NO: 3394794 - protein, 27 aa, Plasmodium falciparum
TSKNSMDSFLLFPKKNITTNNFSHHIN

SEQ ID NO: 3394795 - protein, 32 aa, Plasmodium falciparum
TSLDNLLKRNILTTLSWILQNFKILSHEKHIF

SEQ ID NO: 3394796 - protein, 21 aa, Plasmodium falciparum
TSLFNVSYLTLYFYENYGADT

SEQ ID NO: 3394797 - protein, 34 aa, Plasmodium falciparum
TSLFTEHCIFNLFKLVLLRVSLYIGVFNTKVITL

SEQ ID NO: 3394798 - protein, 18 aa, Plasmodium falciparum
TSLILKYPEIQKKGKHKK

SEQ ID NO: 3394799 - protein, 24 aa, Plasmodium falciparum
TSLIYSIFYGLYDVADILMKRGAD

SEQ ID NO: 3394800 - protein, 21 aa, Plasmodium falciparum
TSLMLNFFFKNVRNIHSFKQK

SEQ ID NO: 3394801 - protein, 20 aa, Plasmodium falciparum
TSLNRIFVERLKLNNPTFQQ

SEQ ID NO: 3394802 - protein, 24 aa, Plasmodium falciparum
TSLPFACIKCKKKWKIEMNPSVTE

SEQ ID NO: 3394803 - protein, 18 aa, Plasmodium falciparum
TSMLLEELILNPTVCKYV

SEQ ID NO: 3394804 - protein, 33 aa, Plasmodium falciparum
TSNDINFCSTIFPKEYYITLFENDEKKDMYYWE

SEQ ID NO: 3394805 - protein, 18 aa, Plasmodium falciparum
TSNGLLYNNMNIINNNNV

SEQ ID NO: 3394806 - protein, 25 aa, Plasmodium falciparum
TSNLKSVILIFVSGKIIITGCKSVN

SEQ ID NO: 3394807 - protein, 40 aa, Plasmodium falciparum
TSNQFLKLVYFMDNFIPFSIYFNIFLNKQICIFSSSFGLC

SEQ ID NO: 3394808 - protein, 33 aa, Plasmodium falciparum
TSNTLTFKKPYIYELIQLPDYVTHNELISSKNE

SEQ ID NO: 3394809 - protein, 22 aa, Plasmodium falciparum
TSPLIPQFIIRKVKAKKMLQLN

SEQ ID NO: 3394810 - protein, 27 aa, Plasmodium falciparum
TSPQVRSIIDFIAIKKAQSLQWGDHID

SEQ ID NO: 3394811 - protein, 36 aa, Plasmodium falciparum
TSQRKSFNKYKFLLNLSKTLLSKKYLSINSSTRFEK

SEQ ID NO: 3394812 - protein, 22 aa, Plasmodium falciparum
TSRLNTYHFFSKKKNFVCLFTT

SEQ ID NO: 3394813 - protein, 29 aa, Plasmodium falciparum
TSSANKKSRSWMSFGKGDKSDKKNKSKSN

SEQ ID NO: 3394814 - protein, 24 aa, Plasmodium falciparum
TSSKNNIFIPLQNNVYLPSQNNVY

SEQ ID NO: 3394815 - protein, 25 aa, Plasmodium falciparum
TSSTRIFIKILLQELTNNLGLQAFY

SEQ ID NO: 3394816 - protein, 31 aa, Plasmodium falciparum
TSTEMRIPYCLLLPNRAIGYVIGKSGNNVRE

SEQ ID NO: 3394817 - protein, 28 aa, Plasmodium falciparum
TSTKKKTSSWLSFGRKDKKDKKASLGSV

SEQ ID NO: 3394818 - protein, 27 aa, Plasmodium falciparum
TSTNKLIHIYMIKKLISEQFKNLQQPV

SEQ ID NO: 3394819 - protein, 25 aa, Plasmodium falciparum
TSTNLKSTLLQTKTKRRVKKKTTDE

SEQ ID NO: 3394820 - protein, 25 aa, Plasmodium falciparum
TSTRQTIFLPVPGLIDASELKPGDL

SEQ ID NO: 3394821 - protein, 20 aa, Plasmodium falciparum
TSVFKSLGFFLSKKKVKSSE

SEQ ID NO: 3394822 - protein, 19 aa, Plasmodium falciparum
TSVICAFGGFIVYLRSLLL

SEQ ID NO: 3394823 - protein, 31 aa, Plasmodium falciparum
TSVQNVINYNLPFSPKLFIHRIGRACRTDIS

SEQ ID NO: 3394824 - protein, 30 aa, Plasmodium falciparum
TSVYASIKNSLWQGRISFAEMAKRKPKVET

SEQ ID NO: 3394825 - protein, 22 aa, Plasmodium falciparum
TSYILKLDFFQQNNLVFDIYTT

SEQ ID NO: 3394826 - protein, 24 aa, Plasmodium falciparum
TTADQKMVIINNKVNHFPNTQTKN

SEQ ID NO: 3394827 - protein, 26 aa, Plasmodium falciparum
TTCNKWYDSIYFRNGIRKNEINEKNV

SEQ ID NO: 3394828 - protein, 24 aa, Plasmodium falciparum
TTDDLIFTLPQNNAFRLCQYRLMV

SEQ ID NO: 3394829 - protein, 24 aa, Plasmodium falciparum
TTDFGILEYLYLEQNIINQVIQKR

SEQ ID NO: 3394830 - protein, 17 aa, Plasmodium falciparum
TTDLYQTNKSRLSTKSE

SEQ ID NO: 3394831 - protein, 26 aa, Plasmodium falciparum
TTDVDIRSFLKDYLDTDYSEDTIYIH

SEQ ID NO: 3394832 - protein, 22 aa, Plasmodium falciparum
TTEEELFDTPLSFEEVMRRKNE

SEQ ID NO: 3394833 - protein, 40 aa, Plasmodium falciparum
TTEGHPEYLPRIPGVRFNPKKQQWLAAWNDNTREIRRYFS

SEQ ID NO: 3394834 - protein, 37 aa, Plasmodium falciparum
TTEKDMHNLFSNFGRCDSLIILKDRRSKSRGSGFVTF

SEQ ID NO: 3394835 - protein, 23 aa, Plasmodium falciparum
TTEKLNYILNYKTPNRYDLNNNV

SEQ ID NO: 3394836 - protein, 27 aa, Plasmodium falciparum
TTFLDIIEEALLYEFIYDDSDYMDHIQ

SEQ ID NO: 3394837 - protein, 22 aa, Plasmodium falciparum
TTFVKFLMCNQFLKVKPTEGLL

SEQ ID NO: 3394838 - protein, 23 aa, Plasmodium falciparum
TTGFFQKYLNIFSKKKNGNESEE

SEQ ID NO: 3394839 - protein, 24 aa, Plasmodium falciparum
TTGVIFVPAFSGLYAPRWRSDARA

SEQ ID NO: 3394840 - protein, 18 aa, Plasmodium falciparum
TTGWIKKLNKKIYEYTYV

SEQ ID NO: 3394841 - protein, 21 aa, Plasmodium falciparum
TTINSFMNKPFINSAKDNTIN

SEQ ID NO: 3394842 - protein, 26 aa, Plasmodium falciparum
TTKNIIRFRFLFQSSTYFTYPVQEIE

SEQ ID NO: 3394843 - protein, 38 aa, Plasmodium falciparum
TTLKKSLTKDVKSKLSKFLIVPIIHPGVATDPRLHFIK

SEQ ID NO: 3394844 - protein, 28 aa, Plasmodium falciparum
TTLLNSRFFLIHFKNINKKFHGILLELS

SEQ ID NO: 3394845 - protein, 27 aa, Plasmodium falciparum
TTLSDFRIYFKFFKMLIERNVHPFLAN

SEQ ID NO: 3394846 - protein, 22 aa, Plasmodium falciparum
TTMLNTPIRKCKIRHIIVSASF

SEQ ID NO: 3394847 - protein, 32 aa, Plasmodium falciparum
TTNEATCDFILYLLSFFIYKMKAIKNEIYEQY

SEQ ID NO: 3394848 - protein, 19 aa, Plasmodium falciparum
TTNEILLLCRAWENYVHPR

SEQ ID NO: 3394849 - protein, 17 aa, Plasmodium falciparum
TTNNTRYKTGESTLPIL

SEQ ID NO: 3394850 - protein, 23 aa, Plasmodium falciparum
TTNPSLIFYEYCKTKVQLKEANK

SEQ ID NO: 3394851 - protein, 21 aa, Plasmodium falciparum
TTNSIFYKKYIDKEKKIKKLK

SEQ ID NO: 3394852 - protein, 17 aa, Plasmodium falciparum
TTNVFWDGFQWVAKTNQ

SEQ ID NO: 3394853 - protein, 21 aa, Plasmodium falciparum
TTPFEIFKWSNILNTKNEKVI

SEQ ID NO: 3394854 - protein, 21 aa, Plasmodium falciparum
TTPLFDFIKNYIFYGKVKDTY

SEQ ID NO: 3394855 - protein, 18 aa, Plasmodium falciparum
TTQHDQLTSFYFNSSENN

SEQ ID NO: 3394856 - protein, 19 aa, Plasmodium falciparum
TTRGTYVAHPYYYNNMRSN

SEQ ID NO: 3394857 - protein, 17 aa, Plasmodium falciparum
TTRIFKTNYLSRKKKKK

SEQ ID NO: 3394858 - protein, 22 aa, Plasmodium falciparum
TTRMHILVTLSYDLSSYDNVSS

SEQ ID NO: 3394859 - protein, 32 aa, Plasmodium falciparum
TTSELVLRPLQPGKWLIIFADEINLPTPDKYD

SEQ ID NO: 3394860 - protein, 23 aa, Plasmodium falciparum
TTSHLLLFNRMSEKYMCDKEMEN

SEQ ID NO: 3394861 - protein, 30 aa, Plasmodium falciparum
TTSYKIRELIKKLYKLCKTEEFCPYDLIID

SEQ ID NO: 3394862 - protein, 20 aa, Plasmodium falciparum
TTVDYYYYTTPFSTQIGNIN

SEQ ID NO: 3394863 - protein, 22 aa, Plasmodium falciparum
TTYGNFPFELCTVLARRFADIG

SEQ ID NO: 3394864 - protein, 33 aa, Plasmodium falciparum
TTYNDKIFNIQNYFKLILDDQLELIQKLEEEKL

SEQ ID NO: 3394865 - protein, 19 aa, Plasmodium falciparum
TVAELLMKQISMIKERNKG

SEQ ID NO: 3394866 - protein, 21 aa, Plasmodium falciparum
TVCNHIGHLPYQCRNFISLEK

SEQ ID NO: 3394867 - protein, 26 aa, Plasmodium falciparum
TVCVFQIPLHFFALLKKTIEYDIDKY

SEQ ID NO: 3394868 - protein, 18 aa, Plasmodium falciparum
TVDLIAERLGLERIGWIF

SEQ ID NO: 3394869 - protein, 20 aa, Plasmodium falciparum
TVDPEWLCELGPLFFYMKNV

SEQ ID NO: 3394870 - protein, 22 aa, Plasmodium falciparum
TVECALLIETLQKLGAQIRWCS

SEQ ID NO: 3394871 - protein, 19 aa, Plasmodium falciparum
TVECEIMFNELPKKIIKID

SEQ ID NO: 3394872 - protein, 22 aa, Plasmodium falciparum
TVENFPIITEKMCQIMESRLNT

SEQ ID NO: 3394873 - protein, 63 aa, Plasmodium falciparum
TVESVYFVNYRAVVVKTKHYYVTQNSYMLFGDVFKIYNLKGEIKKIHAFFPGDENNLSDTLIM

SEQ ID NO: 3394874 - protein, 20 aa, Plasmodium falciparum
TVIGPFHPQFNAITGLNGSG

SEQ ID NO: 3394875 - protein, 21 aa, Plasmodium falciparum
TVIPSYPDITYKNSLNLANSQ

SEQ ID NO: 3394876 - protein, 18 aa, Plasmodium falciparum
TVIPYMSFYLNDVIDKPA

SEQ ID NO: 3394877 - protein, 19 aa, Plasmodium falciparum
TVISVFPYEKFGRHESRNL

SEQ ID NO: 3394878 - protein, 18 aa, Plasmodium falciparum
TVITFHYNYLCRILQCFQ

SEQ ID NO: 3394879 - protein, 21 aa, Plasmodium falciparum
TVKILTGVYKGLLADVIDAER

SEQ ID NO: 3394880 - protein, 21 aa, Plasmodium falciparum
TVLELFLHFENEFKYTPIKMV

SEQ ID NO: 3394881 - protein, 18 aa, Plasmodium falciparum
TVLESILLQTRPSSCLYL

SEQ ID NO: 3394882 - protein, 33 aa, Plasmodium falciparum
TVLKKNEHFGKYGKILNIIINKSQAYNPQYNGP

SEQ ID NO: 3394883 - protein, 19 aa, Plasmodium falciparum
TVMQKLNNLYYKNKYNPVK

SEQ ID NO: 3394884 - protein, 30 aa, Plasmodium falciparum
TVNINSLRNILIDPCINLEIKELRHKIYEI

SEQ ID NO: 3394885 - protein, 20 aa, Plasmodium falciparum
TVQFKKILINQCQDSFENNL

SEQ ID NO: 3394886 - protein, 34 aa, Plasmodium falciparum
TVQNLSKFVILKEFPFTIQIIDPSGLSSLEHYED

SEQ ID NO: 3394887 - protein, 21 aa, Plasmodium falciparum
TVSCNFLPNYPNFSKIGNPLC

SEQ ID NO: 3394888 - protein, 34 aa, Plasmodium falciparum
TVSTLIETYIFLPLKYKYTYLSSLCFHYQTRNII

SEQ ID NO: 3394889 - protein, 18 aa, Plasmodium falciparum
TVVSKRSKYILRHSNVSS

SEQ ID NO: 3394890 - protein, 22 aa, Plasmodium falciparum
TVYDLFPIFKQNKYAYLTFLEV

SEQ ID NO: 3394891 - protein, 18 aa, Plasmodium falciparum
TVYIPTKIKYHMNLCALI

SEQ ID NO: 3394892 - protein, 27 aa, Plasmodium falciparum
TWEQISIEGLFPIIEFARVSQLKKPES

SEQ ID NO: 3394893 - protein, 19 aa, Plasmodium falciparum
TWETDTISGLRFINVLNKK

SEQ ID NO: 3394894 - protein, 27 aa, Plasmodium falciparum
TWNISVCDYLKQQLNILRAADSQQNAN

SEQ ID NO: 3394895 - protein, 27 aa, Plasmodium falciparum
TWSIGCVMGELLLGKPLFLGECASDQL

SEQ ID NO: 3394896 - protein, 26 aa, Plasmodium falciparum
TWTQIFTMDDFYYLKTELINKEKHVL

SEQ ID NO: 3394897 - protein, 22 aa, Plasmodium falciparum
TYDDKFYIICKGLVTVEKNTEG

SEQ ID NO: 3394898 - protein, 22 aa, Plasmodium falciparum
TYDELLRECGYFYLRVNVGQKK

SEQ ID NO: 3394899 - protein, 18 aa, Plasmodium falciparum
TYDLWKKEKKKYVSNALF

SEQ ID NO: 3394900 - protein, 18 aa, Plasmodium falciparum
TYFCELSFGYMDTAEEND

SEQ ID NO: 3394901 - protein, 18 aa, Plasmodium falciparum
TYFGFENKFENIYCGGNN

SEQ ID NO: 3394902 - protein, 20 aa, Plasmodium falciparum
TYFRHIEWIRISPNVYDYDK

SEQ ID NO: 3394903 - protein, 18 aa, Plasmodium falciparum
TYFTSDVVYCYLKLLKLK

SEQ ID NO: 3394904 - protein, 19 aa, Plasmodium falciparum
TYHDIAPVLWNSFGTITTL

SEQ ID NO: 3394905 - protein, 21 aa, Plasmodium falciparum
TYHFNNMRGKQYYLNKYNYNN

SEQ ID NO: 3394906 - protein, 17 aa, Plasmodium falciparum
TYIILLNNITHLGEKGE

SEQ ID NO: 3394907 - protein, 18 aa, Plasmodium falciparum
TYIIPISFVGGETSYSLI

SEQ ID NO: 3394908 - protein, 30 aa, Plasmodium falciparum
TYKKEYIVKYYNYLIKILLSGIRNPNVDEI

SEQ ID NO: 3394909 - protein, 19 aa, Plasmodium falciparum
TYKNLFTNPQLYITHNIYG

SEQ ID NO: 3394910 - protein, 30 aa, Plasmodium falciparum
TYKNPMYVTLYIFNNDILKDIILQVIDIIR

SEQ ID NO: 3394911 - protein, 28 aa, Plasmodium falciparum
TYKRILNYIYLIKLKLKKKIQYIKHKTN

SEQ ID NO: 3394912 - protein, 18 aa, Plasmodium falciparum
TYKVLYNSNLFNNNNKNN

SEQ ID NO: 3394913 - protein, 20 aa, Plasmodium falciparum
TYLENLFSQVKKNFIKILPK

SEQ ID NO: 3394914 - protein, 26 aa, Plasmodium falciparum
TYLNNILKYSFIMDNNIITCILKLIS

SEQ ID NO: 3394915 - protein, 18 aa, Plasmodium falciparum
TYMFGSMHNDIFIPVENM

SEQ ID NO: 3394916 - protein, 36 aa, Plasmodium falciparum
TYMNTTSYKELLGNYINFLDTFNLYDNIYSKEKYET

SEQ ID NO: 3394917 - protein, 20 aa, Plasmodium falciparum
TYMSYLNLYFCIINFKETMF

SEQ ID NO: 3394918 - protein, 23 aa, Plasmodium falciparum
TYMYKKYYKIQNDNFLLYKINRN

SEQ ID NO: 3394919 - protein, 24 aa, Plasmodium falciparum
TYNDLLFKWIYDTGSKILFIYMKE

SEQ ID NO: 3394920 - protein, 25 aa, Plasmodium falciparum
TYNIFHHKWLLKKCNCRGIASYKNI

SEQ ID NO: 3394921 - protein, 18 aa, Plasmodium falciparum
TYNLQYHLSYLPISHVFE

SEQ ID NO: 3394922 - protein, 29 aa, Plasmodium falciparum
TYNNYLKYIPTFFYKFQLDNKIKQIAMGK

SEQ ID NO: 3394923 - protein, 19 aa, Plasmodium falciparum
TYNREFDNLLYTQKKMKKK

SEQ ID NO: 3394924 - protein, 17 aa, Plasmodium falciparum
TYNTHKYIPIKDIIPDH

SEQ ID NO: 3394925 - protein, 23 aa, Plasmodium falciparum
TYNYEFFVNISYDSIIHANIFFG

SEQ ID NO: 3394926 - protein, 17 aa, Plasmodium falciparum
TYPKWCTFVKTGKGRKL

SEQ ID NO: 3394927 - protein, 25 aa, Plasmodium falciparum
TYQSKIEDFFPLLEKKRKTVDDLID

SEQ ID NO: 3394928 - protein, 20 aa, Plasmodium falciparum
TYRFIKYFDVSTVKLFDYHF

SEQ ID NO: 3394929 - protein, 24 aa, Plasmodium falciparum
TYSGTRLLYWDFRDDMDFIIFSPL

SEQ ID NO: 3394930 - protein, 34 aa, Plasmodium falciparum
TYTLIGGLFYNIRRCTKVLLGIDAIIHNSVYGHV

SEQ ID NO: 3394931 - protein, 18 aa, Plasmodium falciparum
TYTSFFEKFQICTYNDIL

SEQ ID NO: 3394932 - protein, 31 aa, Plasmodium falciparum
TYVECLLDDSNLLPFSRNMNIFPMNRRRNHI

SEQ ID NO: 3394933 - protein, 20 aa, Plasmodium falciparum
TYVKNSKMFLIFNSYCITST

SEQ ID NO: 3394934 - protein, 21 aa, Plasmodium falciparum
TYVSNFFLEFLRIYFYNKMKQ

SEQ ID NO: 3394935 - protein, 17 aa, Plasmodium falciparum
TYYLSNNVGYIKTNIYD

SEQ ID NO: 3394936 - protein, 24 aa, Plasmodium falciparum
VAALRLYIELFFKSIDNKQSIQIV

SEQ ID NO: 3394937 - protein, 18 aa, Plasmodium falciparum
VAAQKWLFSLGITITLGR

SEQ ID NO: 3394938 - protein, 18 aa, Plasmodium falciparum
VACIAWCIEILQASFLVA

SEQ ID NO: 3394939 - protein, 23 aa, Plasmodium falciparum
VACSYWEPIIILSKIISDIDIFC

SEQ ID NO: 3394940 - protein, 27 aa, Plasmodium falciparum
VAICAYDYLLFIITCPYIYENVTTTNI

SEQ ID NO: 3394941 - protein, 17 aa, Plasmodium falciparum
VAILRRLPINCGIFRHF

SEQ ID NO: 3394942 - protein, 17 aa, Plasmodium falciparum
VAKRMSSLLLNPQNVID

SEQ ID NO: 3394943 - protein, 25 aa, Plasmodium falciparum
VALTIKERIIPYAVDYYLGIIIESE

SEQ ID NO: 3394944 - protein, 22 aa, Plasmodium falciparum
VANFNMMMNTTNPVLYNNNNNN

SEQ ID NO: 3394945 - protein, 23 aa, Plasmodium falciparum
VAPTPIQIQGWPIALSGKDMIGK

SEQ ID NO: 3394946 - protein, 31 aa, Plasmodium falciparum
VARNVLFEIPVLNKYLFLKDVKKIIPSLTIK

SEQ ID NO: 3394947 - protein, 24 aa, Plasmodium falciparum
VASEFIFNLILPDNNFYMDYVGNE

SEQ ID NO: 3394948 - protein, 26 aa, Plasmodium falciparum
VASYMAYWYETILKVLINYEQLSIQE

SEQ ID NO: 3394949 - protein, 24 aa, Plasmodium falciparum
VATPGRLLDFLENGNINLLKCIYV

SEQ ID NO: 3394950 - protein, 38 aa, Plasmodium falciparum
VATPGRLNDILEKGKIKLFLTTFLVLDEADRMLDMGFS

SEQ ID NO: 3394951 - protein, 17 aa, Plasmodium falciparum
VAYIFKSFNNYFVTNTE

SEQ ID NO: 3394952 - protein, 17 aa, Plasmodium falciparum
VAYSFNIDCLYYTKHTA

SEQ ID NO: 3394953 - protein, 22 aa, Plasmodium falciparum
VAYTIVFRYIQIIIQKIREENN

SEQ ID NO: 3394954 - protein, 30 aa, Plasmodium falciparum
VCDRYKNIIFFIYGKWSQEIYIAYVKDMKK

SEQ ID NO: 3394955 - protein, 24 aa, Plasmodium falciparum
VCDYKIYFKWFFEDNSLYKDFNEV

SEQ ID NO: 3394956 - protein, 26 aa, Plasmodium falciparum
VCEKNMYNMVPWTKSLVEYKNYNNVD

SEQ ID NO: 3394957 - protein, 28 aa, Plasmodium falciparum
VCFDKNRQRWIAHWKIDGKYHKHYFPIS

SEQ ID NO: 3394958 - protein, 27 aa, Plasmodium falciparum
VCGETVDLNIWSDHIFAHKLDSKTTRE

SEQ ID NO: 3394959 - protein, 20 aa, Plasmodium falciparum
VCIAFYGLYGLLHNKYIIID

SEQ ID NO: 3394960 - protein, 19 aa, Plasmodium falciparum
VCKKSCDYYFDTNIKYHEA

SEQ ID NO: 3394961 - protein, 23 aa, Plasmodium falciparum
VCKNKYLGLILLSVLVHRKKIDG

SEQ ID NO: 3394962 - protein, 24 aa, Plasmodium falciparum
VCKRPYIDLFFSSLYPFYEIIIFT

SEQ ID NO: 3394963 - protein, 17 aa, Plasmodium falciparum
VCLLNNNDLYIWGNREI

SEQ ID NO: 3394964 - protein, 24 aa, Plasmodium falciparum
VCLSFYYIQYLRNQLLYGNQNIQI

SEQ ID NO: 3394965 - protein, 17 aa, Plasmodium falciparum
VCLWGLNSYGQLGVNSK

SEQ ID NO: 3394966 - protein, 18 aa, Plasmodium falciparum
VCMILRREFLPGDINFER

SEQ ID NO: 3394967 - protein, 18 aa, Plasmodium falciparum
VCMYCKLVNLIQIKEKFD

SEQ ID NO: 3394968 - protein, 23 aa, Plasmodium falciparum
VCNFTKYLNVKVFLAVPLCERYN

SEQ ID NO: 3394969 - protein, 27 aa, Plasmodium falciparum
VCNKLDHHFILPIYSDVLKFENVKNNI

SEQ ID NO: 3394970 - protein, 18 aa, Plasmodium falciparum
VCNNNCGYSVCRSCLLFY

SEQ ID NO: 3394971 - protein, 18 aa, Plasmodium falciparum
VCQKIKLPINKNLNDKQA

SEQ ID NO: 3394972 - protein, 23 aa, Plasmodium falciparum
VCRKKFTIVISPLISLMKDQVDN

SEQ ID NO: 3394973 - protein, 25 aa, Plasmodium falciparum
VCRKYPPHFGFVKRSMNRPPGPKEK

SEQ ID NO: 3394974 - protein, 26 aa, Plasmodium falciparum
VCSEHFLFERSFFTQSIKGKNGCLVT

SEQ ID NO: 3394975 - protein, 25 aa, Plasmodium falciparum
VCSNDYICIPINLFNFIGTVAFDSI

SEQ ID NO: 3394976 - protein, 18 aa, Plasmodium falciparum
VCTFLYDDFILSKKKKGL

SEQ ID NO: 3394977 - protein, 20 aa, Plasmodium falciparum
VCTLSCKIMFWDISIQEVVG

SEQ ID NO: 3394978 - protein, 19 aa, Plasmodium falciparum
VCTMQPLILCLHKYNDDIT

SEQ ID NO: 3394979 - protein, 29 aa, Plasmodium falciparum
VDASDFLINIILRWNYYTSLKSEKELNLK

SEQ ID NO: 3394980 - protein, 26 aa, Plasmodium falciparum
VDDIDYFMYIKEKNAIKYKDYMNKPK

SEQ ID NO: 3394981 - protein, 19 aa, Plasmodium falciparum
VDDKLFKLKELYFCVICSE

SEQ ID NO: 3394982 - protein, 31 aa, Plasmodium falciparum
VDDKVIDMFVDRVFDRVVHRVVHRVDAKFDD

SEQ ID NO: 3394983 - protein, 22 aa, Plasmodium falciparum
VDDNILNKLLTIKYENKIRNDS

SEQ ID NO: 3394984 - protein, 36 aa, Plasmodium falciparum
VDDYTITIELFYRLKKYNNIFSIEQILGTQYPSILQ

SEQ ID NO: 3394985 - protein, 18 aa, Plasmodium falciparum
VDDYYFNDFLANLSNDIN

SEQ ID NO: 3394986 - protein, 73 aa, Plasmodium falciparum
VDEMWWNENFIKPQVSVSLFLRIFLHDMISPPIFFDDLTSCVIDFFTVNKLWSKAKWVFNIKDCRVFSELIGY

SEQ ID NO: 3394987 - protein, 30 aa, Plasmodium falciparum
VDENIPKDPFNPLLLAYEKKEKKKYRKNDE

SEQ ID NO: 3394988 - protein, 24 aa, Plasmodium falciparum
VDENKHINYMLYNKKEHKSKIQND

SEQ ID NO: 3394989 - protein, 17 aa, Plasmodium falciparum
VDFEKWFVKSLHNEKDV

SEQ ID NO: 3394990 - protein, 24 aa, Plasmodium falciparum
VDGKNIFFDGNKTCMYYYSKDYIS

SEQ ID NO: 3394991 - protein, 25 aa, Plasmodium falciparum
VDHKKKSWILLKDKSKEKIKDKENQ

SEQ ID NO: 3394992 - protein, 26 aa, Plasmodium falciparum
VDIKKNFRNFLYTNKIYPCYVNYYMN

SEQ ID NO: 3394993 - protein, 18 aa, Plasmodium falciparum
VDILNLMKNGYPCRVLYD

SEQ ID NO: 3394994 - protein, 30 aa, Plasmodium falciparum
VDIQISNKMLFPLKMKFLNFEKTLSMNSTN

SEQ ID NO: 3394995 - protein, 31 aa, Plasmodium falciparum
VDISILKKYSSFLKFEYISKNIYLNDKNKNL

SEQ ID NO: 3394996 - protein, 30 aa, Plasmodium falciparum
VDIWSLGICLYVMFYNVVPFSLKISLVELF

SEQ ID NO: 3394997 - protein, 27 aa, Plasmodium falciparum
VDIYCTLYIHLVQNLSLFLKYLKYYNN

SEQ ID NO: 3394998 - protein, 17 aa, Plasmodium falciparum
VDIYIPRKCSATSRLIP

SEQ ID NO: 3394999 - protein, 17 aa, Plasmodium falciparum
VDKEIIIPIITGYTHKF

SEQ ID NO: 3395000 - protein, 17 aa, Plasmodium falciparum
VDKKCKIILPINKKWKI

SEQ ID NO: 3395001 - protein, 17 aa, Plasmodium falciparum
VDKKHYRFCIKKLCDKI

SEQ ID NO: 3395002 - protein, 18 aa, Plasmodium falciparum
VDKKIFFKKIINSNDIIK

SEQ ID NO: 3395003 - protein, 28 aa, Plasmodium falciparum
VDKNLDQKIILFIGSPFHVNEKQLINTG

SEQ ID NO: 3395004 - protein, 22 aa, Plasmodium falciparum
VDKNLFEIFLNKIKNIKIIDIN

SEQ ID NO: 3395005 - protein, 25 aa, Plasmodium falciparum
VDKRKKLILILNKADFLTYEERKIW

SEQ ID NO: 3395006 - protein, 23 aa, Plasmodium falciparum
VDKYNGIFPNDLKLLKTLPGIGD

SEQ ID NO: 3395007 - protein, 18 aa, Plasmodium falciparum
VDKYTPMKVLLECLNKSK

SEQ ID NO: 3395008 - protein, 25 aa, Plasmodium falciparum
VDLFACPLYNLDLASIYPLIKNSGG

SEQ ID NO: 3395009 - protein, 22 aa, Plasmodium falciparum
VDLFNPYCAVFYIRKLKNLQEL

SEQ ID NO: 3395010 - protein, 18 aa, Plasmodium falciparum
VDLFVLLKTIKSFHSEFP

SEQ ID NO: 3395011 - protein, 20 aa, Plasmodium falciparum
VDLLIALKSFIKDYTLPPYE

SEQ ID NO: 3395012 - protein, 22 aa, Plasmodium falciparum
VDLQFVLRWHLYSESKSISLVA

SEQ ID NO: 3395013 - protein, 22 aa, Plasmodium falciparum
VDLYPDLVFFKCQVLNINGDNY

SEQ ID NO: 3395014 - protein, 25 aa, Plasmodium falciparum
VDMEDIMHMFLYYTNQDYFLKFIQN

SEQ ID NO: 3395015 - protein, 24 aa, Plasmodium falciparum
VDNFCLREFLKYCKDLTCIDFSNC

SEQ ID NO: 3395016 - protein, 25 aa, Plasmodium falciparum
VDNFNWLKEKIQLLCLKYNLELIKT

SEQ ID NO: 3395017 - protein, 29 aa, Plasmodium falciparum
VDNNIALNSKFAYLAIYTCENNCDIFDIN

SEQ ID NO: 3395018 - protein, 25 aa, Plasmodium falciparum
VDNNIKPLYHIWNKKNYTTDCDKKK

SEQ ID NO: 3395019 - protein, 28 aa, Plasmodium falciparum
VDNPQKYPNLFYKIKNLKRNNDKLKYIH

SEQ ID NO: 3395020 - protein, 27 aa, Plasmodium falciparum
VDNYYQNKNYYYLYNNNNGMLVKTYVV

SEQ ID NO: 3395021 - protein, 32 aa, Plasmodium falciparum
VDPRDIEICRFLRKYILLKHPQGKYINKKEQQ

SEQ ID NO: 3395022 - protein, 21 aa, Plasmodium falciparum
VDPVCRYFGLSKGQVVKIIRP

SEQ ID NO: 3395023 - protein, 22 aa, Plasmodium falciparum
VDPYNIYRIEKKDDIYFSMFKN

SEQ ID NO: 3395024 - protein, 18 aa, Plasmodium falciparum
VDQKEYMNFLRKNRIETK

SEQ ID NO: 3395025 - protein, 38 aa, Plasmodium falciparum
VDQLNYYLNNKFNYFLGHTNFMKKIFKKKKKLLKDDER

SEQ ID NO: 3395026 - protein, 24 aa, Plasmodium falciparum
VDRSAAYYLRFIAKSLVANKFCRR

SEQ ID NO: 3395027 - protein, 27 aa, Plasmodium falciparum
VDRTKYKIQILLPPKIDPSVTMMTVEE

SEQ ID NO: 3395028 - protein, 34 aa, Plasmodium falciparum
VDRYNQINYTNSFWSYIFGYFNNIYNNWSQEKED

SEQ ID NO: 3395029 - protein, 23 aa, Plasmodium falciparum
VDSFLIYLDLYFINKYFNKKFNS

SEQ ID NO: 3395030 - protein, 17 aa, Plasmodium falciparum
VDSIFVENIKKPLLYEI

SEQ ID NO: 3395031 - protein, 18 aa, Plasmodium falciparum
VDSIISLFRVDFSGRGEL

SEQ ID NO: 3395032 - protein, 28 aa, Plasmodium falciparum
VDSIKYLQVFIFLSDIKINKIKSYIFKC

SEQ ID NO: 3395033 - protein, 19 aa, Plasmodium falciparum
VDSSIGFKHMYINNVQSAC

SEQ ID NO: 3395034 - protein, 35 aa, Plasmodium falciparum
VDTFHKLKCYQKCGVLWLYVLYKQNKNGILADEMG

SEQ ID NO: 3395035 - protein, 18 aa, Plasmodium falciparum
VDTFNYEFLCDKCSYRSK

SEQ ID NO: 3395036 - protein, 28 aa, Plasmodium falciparum
VDTLKPFQMVLLLYSLSKLKIYSYKFVK

SEQ ID NO: 3395037 - protein, 17 aa, Plasmodium falciparum
VDTQLISLMSIPMKVQL

SEQ ID NO: 3395038 - protein, 36 aa, Plasmodium falciparum
VDVNKRIRLCELSSDPWMQEMWKLSFQKNLNTNQNI

SEQ ID NO: 3395039 - protein, 23 aa, Plasmodium falciparum
VDWWSLGIMLYEMLTGELPFNNT

SEQ ID NO: 3395040 - protein, 18 aa, Plasmodium falciparum
VEAIYLSLSNLKDSVTDE

SEQ ID NO: 3395041 - protein, 24 aa, Plasmodium falciparum
VECFANMLSSILYSNRFSPYFVNP

SEQ ID NO: 3395042 - protein, 20 aa, Plasmodium falciparum
VECLLYIYNLFYNYDRDVIN

SEQ ID NO: 3395043 - protein, 24 aa, Plasmodium falciparum
VEDERFEWLVKHFNPKSNVHAYLS

SEQ ID NO: 3395044 - protein, 24 aa, Plasmodium falciparum
VEDIEEIFLYKDKIDYMLNLEKSI

SEQ ID NO: 3395045 - protein, 24 aa, Plasmodium falciparum
VEDNVRYFILYGLNKFKGNKKKEF

SEQ ID NO: 3395046 - protein, 23 aa, Plasmodium falciparum
VEEKKIVYLIYDGLYIQRKDITN

SEQ ID NO: 3395047 - protein, 25 aa, Plasmodium falciparum
VEEKKKFFSFLKTFYDNILENEDLL

SEQ ID NO: 3395048 - protein, 18 aa, Plasmodium falciparum
VEELRPLPGNLAPSQSAI

SEQ ID NO: 3395049 - protein, 17 aa, Plasmodium falciparum
VEEYFVILISILQLEFK

SEQ ID NO: 3395050 - protein, 30 aa, Plasmodium falciparum
VEFLQAFHEILYSLKPLFMEEPKYLPIIET

SEQ ID NO: 3395051 - protein, 28 aa, Plasmodium falciparum
VEFVEYKNFVLLITKSVRKLQLEALYGL

SEQ ID NO: 3395052 - protein, 17 aa, Plasmodium falciparum
VEGILEHTLFKGTFFPT

SEQ ID NO: 3395053 - protein, 25 aa, Plasmodium falciparum
VEIDILIPLSFACNKIILVGDPKQL

SEQ ID NO: 3395054 - protein, 19 aa, Plasmodium falciparum
VEIFFPYDYIYPEQYAYMK

SEQ ID NO: 3395055 - protein, 18 aa, Plasmodium falciparum
VEIKRTLNYKGVSNFYIN

SEQ ID NO: 3395056 - protein, 25 aa, Plasmodium falciparum
VEIMRLKHILILQNKVELIKEEQAL

SEQ ID NO: 3395057 - protein, 33 aa, Plasmodium falciparum
VEIVACIITNLLGTYFKCFFYVKEITLNKLESG

SEQ ID NO: 3395058 - protein, 20 aa, Plasmodium falciparum
VEIYKWFHQSYKSAIEIPEI

SEQ ID NO: 3395059 - protein, 26 aa, Plasmodium falciparum
VEIYQKTIFYPLHLKTLNFKEKPTTK

SEQ ID NO: 3395060 - protein, 24 aa, Plasmodium falciparum
VEKARVYYFGTYYASQLIAAPSNY

SEQ ID NO: 3395061 - protein, 19 aa, Plasmodium falciparum
VEKAVSLITPLLDPFHPLH

SEQ ID NO: 3395062 - protein, 23 aa, Plasmodium falciparum
VEKIDPIKNFFFTPNHITQEEGK

SEQ ID NO: 3395063 - protein, 31 aa, Plasmodium falciparum
VEKRNYVRSWIIKLIVKYKIKDSKKIKEILK

SEQ ID NO: 3395064 - protein, 25 aa, Plasmodium falciparum
VELDCPPPLIVPYPAVHFHNTSEVM

SEQ ID NO: 3395065 - protein, 27 aa, Plasmodium falciparum
VELIDKFRLFYTYLSPLITKLKKTIYA

SEQ ID NO: 3395066 - protein, 35 aa, Plasmodium falciparum
VELNKQIKFIMKLMQKLGLSAILTGTVPPGRNIEN

SEQ ID NO: 3395067 - protein, 19 aa, Plasmodium falciparum
VELVYRCISLLPKHIQKYF

SEQ ID NO: 3395068 - protein, 28 aa, Plasmodium falciparum
VENCADYIIFEFMTTRNLMRFKVSNYES

SEQ ID NO: 3395069 - protein, 30 aa, Plasmodium falciparum
VENINLPPSLFSRFDLIYLVIDQANEDEDR

SEQ ID NO: 3395070 - protein, 31 aa, Plasmodium falciparum
VEPYILKTKVYEPLWLIGSGKLKNLDIRIRV

SEQ ID NO: 3395071 - protein, 17 aa, Plasmodium falciparum
VEPYPPLCDIKNSFTSQ

SEQ ID NO: 3395072 - protein, 117 aa, Plasmodium falciparum
VEQKQKKRLLGIVKLIGELFQRQIVSISIVISIAHDLLIAYEEPKEYCIEAFLQLIYSTGFFIDKIEKYKNVLDTWFGRLKELQRKKMYSKRIKFVIQDVFDLRSSEWRKKTHKDTA

SEQ ID NO: 3395073 - protein, 25 aa, Plasmodium falciparum
VEQNNNLIQVLQKCFKHFNLYNGNS

SEQ ID NO: 3395074 - protein, 27 aa, Plasmodium falciparum
VERKYLSNVFKIFSYCLYITFVDNDVI

SEQ ID NO: 3395075 - protein, 18 aa, Plasmodium falciparum
VERNLAIGIYHKFMKLKD

SEQ ID NO: 3395076 - protein, 20 aa, Plasmodium falciparum
VERVLPFWFDHIAPDILANK

SEQ ID NO: 3395077 - protein, 25 aa, Plasmodium falciparum
VESIRIYPLINYVPKNSFLNVIIFY

SEQ ID NO: 3395078 - protein, 26 aa, Plasmodium falciparum
VESKKSYFIGYMINRLLLAELGRIKE

SEQ ID NO: 3395079 - protein, 26 aa, Plasmodium falciparum
VESLRAIPWVFSWTQNRMHLSVWLGI

SEQ ID NO: 3395080 - protein, 33 aa, Plasmodium falciparum
VESLSFFFHCCNINTYYWYKKEIDINNMKIIFY

SEQ ID NO: 3395081 - protein, 23 aa, Plasmodium falciparum
VETKLDLYKYYKQSTVGNCNIKE

SEQ ID NO: 3395082 - protein, 24 aa, Plasmodium falciparum
VEVPHVILQEKLIHIPKPVIHERI

SEQ ID NO: 3395083 - protein, 27 aa, Plasmodium falciparum
VEVRKERIINIPLSVPMELLQSVQNKE

SEQ ID NO: 3395084 - protein, 42 aa, Plasmodium falciparum
VEWSKYDVVWFFREYFYRLAINKNIFFPLIEHVYLLKNQPSA

SEQ ID NO: 3395085 - protein, 27 aa, Plasmodium falciparum
VEYDNGQHFFFINDKTYMLEQDKEINY

SEQ ID NO: 3395086 - protein, 26 aa, Plasmodium falciparum
VEYNRKILFTLFTTYLLLEYDYSYFT

SEQ ID NO: 3395087 - protein, 24 aa, Plasmodium falciparum
VEYRKNILNFFFKKDLFNEIHNNN

SEQ ID NO: 3395088 - protein, 20 aa, Plasmodium falciparum
VEYSIFKKHLVDCKLNVNKE

SEQ ID NO: 3395089 - protein, 17 aa, Plasmodium falciparum
VFCNPYFAKAALEIPLF

SEQ ID NO: 3395090 - protein, 25 aa, Plasmodium falciparum
VFDSSVLPNRLPWDGGRHAKSLIHM

SEQ ID NO: 3395091 - protein, 24 aa, Plasmodium falciparum
VFDYLCIGAIIEGKYFCIHGGLSP

SEQ ID NO: 3395092 - protein, 21 aa, Plasmodium falciparum
VFELLFFDEVIYDKSCLLKKW

SEQ ID NO: 3395093 - protein, 21 aa, Plasmodium falciparum
VFGDAWLLSLTGENPLRIQEY

SEQ ID NO: 3395094 - protein, 34 aa, Plasmodium falciparum
VFGDVHGNLFDLLDFFNLYNWPMHNNKNLLLTES

SEQ ID NO: 3395095 - protein, 21 aa, Plasmodium falciparum
VFIFNVYLYLEYNNILQYYDF

SEQ ID NO: 3395096 - protein, 33 aa, Plasmodium falciparum
VFIHSYFCIKNILSLLIFYIVTTLKYDIQYVIS

SEQ ID NO: 3395097 - protein, 18 aa, Plasmodium falciparum
VFIVGFARTPIGALGGCI

SEQ ID NO: 3395098 - protein, 27 aa, Plasmodium falciparum
VFKKVNNFLWAFKLKPPRKGFKAKRHA

SEQ ID NO: 3395099 - protein, 19 aa, Plasmodium falciparum
VFLDYMYKTGTIKNKTIIV

SEQ ID NO: 3395100 - protein, 21 aa, Plasmodium falciparum
VFLIIIDYYNIFTEQLIRELI

SEQ ID NO: 3395101 - protein, 21 aa, Plasmodium falciparum
VFLIPERKIIFVFYNNYNKIS

SEQ ID NO: 3395102 - protein, 35 aa, Plasmodium falciparum
VFLYVERLFDIIEPKKLLYMAIDGVAPKAKMNQQR

SEQ ID NO: 3395103 - protein, 26 aa, Plasmodium falciparum
VFNDKFYLRYIYKWPHMNIITKEIDD

SEQ ID NO: 3395104 - protein, 17 aa, Plasmodium falciparum
VFNILKNKKLMGKKLFH

SEQ ID NO: 3395105 - protein, 21 aa, Plasmodium falciparum
VFNSKLVLLGDTSVGKSCIVV

SEQ ID NO: 3395106 - protein, 19 aa, Plasmodium falciparum
VFNYIIKRLDAIPPYVVVN

SEQ ID NO: 3395107 - protein, 17 aa, Plasmodium falciparum
VFPSLKKYNTVPHISNN

SEQ ID NO: 3395108 - protein, 30 aa, Plasmodium falciparum
VFRNEEYISLIWVLEKLFGDVKHIKPRSSR

SEQ ID NO: 3395109 - protein, 24 aa, Plasmodium falciparum
VFSKIDLLKYFKNDLKFPLSYYVE

SEQ ID NO: 3395110 - protein, 29 aa, Plasmodium falciparum
VFSKVFTRVLFRIWDIWQIRHYRNYPNVF

SEQ ID NO: 3395111 - protein, 27 aa, Plasmodium falciparum
VFTGNNSVFNILPSLYTKVENEIDVNN

SEQ ID NO: 3395112 - protein, 26 aa, Plasmodium falciparum
VFTLHKSYLYYLLEDIIKYKINTQLY

SEQ ID NO: 3395113 - protein, 30 aa, Plasmodium falciparum
VFTQQKYKQLLEGFLLFVQTNKYIHQKITE

SEQ ID NO: 3395114 - protein, 22 aa, Plasmodium falciparum
VFVIYLIYIRPNVSQFTSEYEG

SEQ ID NO: 3395115 - protein, 18 aa, Plasmodium falciparum
VFVRMESIFYGQKAIKDL

SEQ ID NO: 3395116 - protein, 18 aa, Plasmodium falciparum
VFWLCKWIKQREKEIKND

SEQ ID NO: 3395117 - protein, 19 aa, Plasmodium falciparum
VFYYLICSFQDKQFIHVRC

SEQ ID NO: 3395118 - protein, 24 aa, Plasmodium falciparum
VGADKYIMIWVKKNNEKIRKTNNS

SEQ ID NO: 3395119 - protein, 32 aa, Plasmodium falciparum
VGCSKYSFFDIVSILLYLDSYNKYIKAIGLNC

SEQ ID NO: 3395120 - protein, 29 aa, Plasmodium falciparum
VGDLNSASYYILLARRFLSALACHPNNFR

SEQ ID NO: 3395121 - protein, 23 aa, Plasmodium falciparum
VGESFYVPMLSTVLDLLKESKLL

SEQ ID NO: 3395122 - protein, 19 aa, Plasmodium falciparum
VGFLLAGIGFRDGLGKKNF

SEQ ID NO: 3395123 - protein, 19 aa, Plasmodium falciparum
VGFTFSFPCTSPSINCSIL

SEQ ID NO: 3395124 - protein, 23 aa, Plasmodium falciparum
VGGKLLDRLYLSNKAHILFDIHQ

SEQ ID NO: 3395125 - protein, 24 aa, Plasmodium falciparum
VGGKWFVRELFLYMISRYGYENIT

SEQ ID NO: 3395126 - protein, 22 aa, Plasmodium falciparum
VGIDFNINYYKIQYAQLCINEL

SEQ ID NO: 3395127 - protein, 18 aa, Plasmodium falciparum
VGILPLSIAFGYKNMRNF

SEQ ID NO: 3395128 - protein, 18 aa, Plasmodium falciparum
VGIMKKELKISLYDFIML

SEQ ID NO: 3395129 - protein, 17 aa, Plasmodium falciparum
VGINIVIKVIYINNIKK

SEQ ID NO: 3395130 - protein, 19 aa, Plasmodium falciparum
VGKVAIILTGKHMGKRCII

SEQ ID NO: 3395131 - protein, 26 aa, Plasmodium falciparum
VGLEIFFDYIIQIDDLKLLDSSKRTY

SEQ ID NO: 3395132 - protein, 18 aa, Plasmodium falciparum
VGMMRIICHFYAQCLRTL

SEQ ID NO: 3395133 - protein, 17 aa, Plasmodium falciparum
VGNIYCDVEKKGDIKYI

SEQ ID NO: 3395134 - protein, 24 aa, Plasmodium falciparum
VGNVNYMMKYGPSDKIILNGINHS

SEQ ID NO: 3395135 - protein, 24 aa, Plasmodium falciparum
VGPEYYVNILSFVDKDLLEPGCSV

SEQ ID NO: 3395136 - protein, 25 aa, Plasmodium falciparum
VGRIKPFNVLGACQLPSLCTPSYTT

SEQ ID NO: 3395137 - protein, 29 aa, Plasmodium falciparum
VGSIKSLKYRLYYLPGINFLSSICSTCRT

SEQ ID NO: 3395138 - protein, 18 aa, Plasmodium falciparum
VGVFTYIRKLNLDEKWSS

SEQ ID NO: 3395139 - protein, 53 aa, Plasmodium falciparum
VGVHYDRKQFRWKATWYTSHGRRCAKYYPVKQYGYLEAKKMAIECRKAYNLYK

SEQ ID NO: 3395140 - protein, 19 aa, Plasmodium falciparum
VGVPYSWEYVEDSKSWFIV

SEQ ID NO: 3395141 - protein, 17 aa, Plasmodium falciparum
VGVSQLFNKINKNGYHI

SEQ ID NO: 3395142 - protein, 35 aa, Plasmodium falciparum
VGYAFINFIHPYYAELFIKFFNNYKLNAFKSNKVC

SEQ ID NO: 3395143 - protein, 22 aa, Plasmodium falciparum
VHAAHVLLLQRLESAYMQLRTM

SEQ ID NO: 3395144 - protein, 26 aa, Plasmodium falciparum
VHCDASFICRLLYEGFIPVASKQKLY

SEQ ID NO: 3395145 - protein, 21 aa, Plasmodium falciparum
VHCVAAFQWASKEGVLCEENM

SEQ ID NO: 3395146 - protein, 21 aa, Plasmodium falciparum
VHEDCYSLIYLFGGKGNTIKN

SEQ ID NO: 3395147 - protein, 27 aa, Plasmodium falciparum
VHEIRKMTLPYLDKFQRKNVQNFQIKT

SEQ ID NO: 3395148 - protein, 37 aa, Plasmodium falciparum
VHFVYQCTNIIDLVPYFFIFKNIIKQKTLPSTQSLYI

SEQ ID NO: 3395149 - protein, 27 aa, Plasmodium falciparum
VHGNNNFDIYIPPAPFDSADNIISNNK

SEQ ID NO: 3395150 - protein, 18 aa, Plasmodium falciparum
VHIHNSCNIYVYINERTS

SEQ ID NO: 3395151 - protein, 27 aa, Plasmodium falciparum
VHKKDIYNMSPLDIVQIKKFKDIKNYL

SEQ ID NO: 3395152 - protein, 19 aa, Plasmodium falciparum
VHKKYTCDFSIIEHAEKRR

SEQ ID NO: 3395153 - protein, 21 aa, Plasmodium falciparum
VHLNLKFIILKNIEKDDNCLC

SEQ ID NO: 3395154 - protein, 19 aa, Plasmodium falciparum
VHMDFEVGIFILQFINSIF

SEQ ID NO: 3395155 - protein, 25 aa, Plasmodium falciparum
VHMNFRFFQIFIKTGKKKKKYNNLN

SEQ ID NO: 3395156 - protein, 17 aa, Plasmodium falciparum
VHNFCYYSAKKFNTYDE

SEQ ID NO: 3395157 - protein, 22 aa, Plasmodium falciparum
VHNPYLLFYNTQDEGWLIIVKN

SEQ ID NO: 3395158 - protein, 26 aa, Plasmodium falciparum
VHNSLICIVDELFILHNLQGEEIFAK

SEQ ID NO: 3395159 - protein, 19 aa, Plasmodium falciparum
VHPKYFKFSFLNKIEKIMF

SEQ ID NO: 3395160 - protein, 20 aa, Plasmodium falciparum
VHPSHFYLDTSFSTLRFALK

SEQ ID NO: 3395161 - protein, 25 aa, Plasmodium falciparum
VHQGFGPWKLLFKEQKYNVYFQVDG

SEQ ID NO: 3395162 - protein, 17 aa, Plasmodium falciparum
VHSRARVRLYKLAKRKG

SEQ ID NO: 3395163 - protein, 26 aa, Plasmodium falciparum
VHTELIYLIIKYLYYERILPEANEIK

SEQ ID NO: 3395164 - protein, 29 aa, Plasmodium falciparum
VHTKNNFLGDVYIFKIKGLNNSKIVSYNV

SEQ ID NO: 3395165 - protein, 31 aa, Plasmodium falciparum
VHTLTTSQIIYILSYFKKLAVHNGKELMCYL

SEQ ID NO: 3395166 - protein, 25 aa, Plasmodium falciparum
VHVDNDMLYYCGMKDDIENLKELIE

SEQ ID NO: 3395167 - protein, 28 aa, Plasmodium falciparum
VHVIFFNTFLNSFFNMLPIFFRDHRKIL

SEQ ID NO: 3395168 - protein, 18 aa, Plasmodium falciparum
VHVQRIIEHPIPKDAMNN

SEQ ID NO: 3395169 - protein, 17 aa, Plasmodium falciparum
VHWLINEYSMENTNGDG

SEQ ID NO: 3395170 - protein, 18 aa, Plasmodium falciparum
VHYLTINKYMLSFNDIND

SEQ ID NO: 3395171 - protein, 23 aa, Plasmodium falciparum
VICHIFRTFLLQHNFVEIHTPKL

SEQ ID NO: 3395172 - protein, 22 aa, Plasmodium falciparum
VIDIFYELKDLVKVHEILIYKE

SEQ ID NO: 3395173 - protein, 19 aa, Plasmodium falciparum
VIDPYIGVHLKNLGINIMN

SEQ ID NO: 3395174 - protein, 30 aa, Plasmodium falciparum
VIDVLQLYDKYPYIFQYKDLTKIEVFVICV

SEQ ID NO: 3395175 - protein, 27 aa, Plasmodium falciparum
VIEDEKVFIEFFYAKKASFNKNVRDRN

SEQ ID NO: 3395176 - protein, 26 aa, Plasmodium falciparum
VIENEEKHLLPLELEYNLVSSDEKFG

SEQ ID NO: 3395177 - protein, 17 aa, Plasmodium falciparum
VIFDLLWSDPQKKEGIG

SEQ ID NO: 3395178 - protein, 19 aa, Plasmodium falciparum
VIFFKHVILNTNDTYFILI

SEQ ID NO: 3395179 - protein, 17 aa, Plasmodium falciparum
VIFYINKGVMYWHGRDK

SEQ ID NO: 3395180 - protein, 17 aa, Plasmodium falciparum
VIGDLILRQISKYGDKK

SEQ ID NO: 3395181 - protein, 20 aa, Plasmodium falciparum
VIIIILCYFVEKNATIKIRR

SEQ ID NO: 3395182 - protein, 18 aa, Plasmodium falciparum
VIIKFEDNIIKFKEINKL

SEQ ID NO: 3395183 - protein, 24 aa, Plasmodium falciparum
VIIKNVLTLVLWDIESTVRQATEK

SEQ ID NO: 3395184 - protein, 26 aa, Plasmodium falciparum
VIINGIVLRRWKRLYKDIRCDSELFI

SEQ ID NO: 3395185 - protein, 21 aa, Plasmodium falciparum
VIKDYILKKLGWNVIHIPYQE

SEQ ID NO: 3395186 - protein, 24 aa, Plasmodium falciparum
VIKEKSFLMKISWNYIVVDEGHRM

SEQ ID NO: 3395187 - protein, 25 aa, Plasmodium falciparum
VIKLNYENFLTKYKLNSGNEQKDLS

SEQ ID NO: 3395188 - protein, 19 aa, Plasmodium falciparum
VILEYKLCIYRLKDIILLE

SEQ ID NO: 3395189 - protein, 17 aa, Plasmodium falciparum
VILIYEYVKNRDINCNE

SEQ ID NO: 3395190 - protein, 19 aa, Plasmodium falciparum
VILKLYQDRTHRIDSHVFD

SEQ ID NO: 3395191 - protein, 18 aa, Plasmodium falciparum
VILNYMKKDILFYNTFNR

SEQ ID NO: 3395192 - protein, 19 aa, Plasmodium falciparum
VILYVHRPIYGNEPMNLIP

SEQ ID NO: 3395193 - protein, 26 aa, Plasmodium falciparum
VINEKNIHFYKKYSSYLLYLSNEKQI

SEQ ID NO: 3395194 - protein, 18 aa, Plasmodium falciparum
VINKMDGFYKSLTPHEIK

SEQ ID NO: 3395195 - protein, 18 aa, Plasmodium falciparum
VINTFKKKNIILANNCLV

SEQ ID NO: 3395196 - protein, 29 aa, Plasmodium falciparum
VINVPSTSRCYFALSLQSYRHDNPENSTQ

SEQ ID NO: 3395197 - protein, 19 aa, Plasmodium falciparum
VIQIIYVMDNIWKRYGLDL

SEQ ID NO: 3395198 - protein, 18 aa, Plasmodium falciparum
VIQKFNSVVFFCDASGFS

SEQ ID NO: 3395199 - protein, 34 aa, Plasmodium falciparum
VIQNEFTFLYDLFDYIKIDIYFNYIFNTNKMHNS

SEQ ID NO: 3395200 - protein, 31 aa, Plasmodium falciparum
VIQVFCFKPPNFYLICQFSLTSIGFKNSKKL

SEQ ID NO: 3395201 - protein, 18 aa, Plasmodium falciparum
VISPKKKKKLFIENEKNI

SEQ ID NO: 3395202 - protein, 27 aa, Plasmodium falciparum
VITKKTLQMFFTSKIFYEILNHFKNLS

SEQ ID NO: 3395203 - protein, 26 aa, Plasmodium falciparum
VIVKIIWSFAFLKIRDIHLFVDFSIS

SEQ ID NO: 3395204 - protein, 23 aa, Plasmodium falciparum
VIVKSLDINLLLNKNYMDDDEEK

SEQ ID NO: 3395205 - protein, 25 aa, Plasmodium falciparum
VIVTNLPDNCRWQHLKDIMRQCGDV

SEQ ID NO: 3395206 - protein, 26 aa, Plasmodium falciparum
VKAHEYKRIDLLNTNYKRSIMNNINN

SEQ ID NO: 3395207 - protein, 25 aa, Plasmodium falciparum
VKALYKLGVANMYFGFLEEAKENLY

SEQ ID NO: 3395208 - protein, 31 aa, Plasmodium falciparum
VKCFIYDYNEKLKLYIKLKRYDLNNFVINNS

SEQ ID NO: 3395209 - protein, 18 aa, Plasmodium falciparum
VKCKCDHHRFSAEYLNIK

SEQ ID NO: 3395210 - protein, 34 aa, Plasmodium falciparum
VKCNPFIINNFFFKKWIYKIPYDKSELIFSKMKN

SEQ ID NO: 3395211 - protein, 30 aa, Plasmodium falciparum
VKCVIELMYPLALTYGLRFSLREGGKTVAS

SEQ ID NO: 3395212 - protein, 17 aa, Plasmodium falciparum
VKDLFVKSFNILNTINQ

SEQ ID NO: 3395213 - protein, 31 aa, Plasmodium falciparum
VKDLKYLCSRLYSIPLPKMRLFYTDENNPLC

SEQ ID NO: 3395214 - protein, 20 aa, Plasmodium falciparum
VKDLYKFNVSLGIQNEQLLK

SEQ ID NO: 3395215 - protein, 26 aa, Plasmodium falciparum
VKDNIMKYLIFFTSYIRNIQYDINSC

SEQ ID NO: 3395216 - protein, 25 aa, Plasmodium falciparum
VKDYDYLLSMPIFSLTLEKVEDLLT

SEQ ID NO: 3395217 - protein, 21 aa, Plasmodium falciparum
VKEIIKNIKMRLGFYSNEESD

SEQ ID NO: 3395218 - protein, 25 aa, Plasmodium falciparum
VKEKKNILRIFDKQRKQLLKEEKKM

SEQ ID NO: 3395219 - protein, 32 aa, Plasmodium falciparum
VKELDENWLIKLLIYMNSLLQLERLRLEDMKI

SEQ ID NO: 3395220 - protein, 30 aa, Plasmodium falciparum
VKESAKITNRLWNNNIDRYSYKNGRNGVYY

SEQ ID NO: 3395221 - protein, 25 aa, Plasmodium falciparum
VKHKPYKLFLIRNYTHKYNSINAES

SEQ ID NO: 3395222 - protein, 26 aa, Plasmodium falciparum
VKHKRTQEFFCWKAISYRGLKEREKS

SEQ ID NO: 3395223 - protein, 17 aa, Plasmodium falciparum
VKIIKSVDLLLKTKSFT

SEQ ID NO: 3395224 - protein, 18 aa, Plasmodium falciparum
VKIPHIRVNIKNTIFSIP

SEQ ID NO: 3395225 - protein, 17 aa, Plasmodium falciparum
VKIYIKCFKDGKYKILS

SEQ ID NO: 3395226 - protein, 21 aa, Plasmodium falciparum
VKKDILLELKLWQNEKKKSNN

SEQ ID NO: 3395227 - protein, 26 aa, Plasmodium falciparum
VKKKKKYFTDQKFLRKFKKSRQPNED

SEQ ID NO: 3395228 - protein, 17 aa, Plasmodium falciparum
VKKKVFLIPERKIIFVF

SEQ ID NO: 3395229 - protein, 26 aa, Plasmodium falciparum
VKKLKRNILCIINKFIQTNNGKKKNP

SEQ ID NO: 3395230 - protein, 23 aa, Plasmodium falciparum
VKKMHPWVNIEEILKHSFIGYVE

SEQ ID NO: 3395231 - protein, 17 aa, Plasmodium falciparum
VKKNPIHFYFNKFNMPS

SEQ ID NO: 3395232 - protein, 26 aa, Plasmodium falciparum
VKKPAIRGITSFTLFAREKRKELLDQ

SEQ ID NO: 3395233 - protein, 18 aa, Plasmodium falciparum
VKLCLKLSPTKDILTKKL

SEQ ID NO: 3395234 - protein, 19 aa, Plasmodium falciparum
VKLCMKYKEYSQVDNTIML

SEQ ID NO: 3395235 - protein, 37 aa, Plasmodium falciparum
VKLKTMVMSKRYKKTFLLIEELFRLKIIKDNENQLEV

SEQ ID NO: 3395236 - protein, 20 aa, Plasmodium falciparum
VKLLLKRKLICYDGFEPSGR

SEQ ID NO: 3395237 - protein, 33 aa, Plasmodium falciparum
VKLVFDILDLYRRWYEEYLAVPIIKGIKSEGEK

SEQ ID NO: 3395238 - protein, 38 aa, Plasmodium falciparum
VKMCYDYNLLPKYKYKDILCYIFRLSKSLKVGYIEYKH

SEQ ID NO: 3395239 - protein, 38 aa, Plasmodium falciparum
VKMKKKRTYIFFINKTYKLFIHNYKNISFKFENLMRKH

SEQ ID NO: 3395240 - protein, 25 aa, Plasmodium falciparum
VKNAYVFIYTCINPEFIDFYNKYVD

SEQ ID NO: 3395241 - protein, 26 aa, Plasmodium falciparum
VKNEEYMEIILTNFINTIINNLEDIK

SEQ ID NO: 3395242 - protein, 23 aa, Plasmodium falciparum
VKNFCDYFLPQLKYNNFNILYTF

SEQ ID NO: 3395243 - protein, 21 aa, Plasmodium falciparum
VKNIHNLSHGYYINNLKINLC

SEQ ID NO: 3395244 - protein, 22 aa, Plasmodium falciparum
VKNILNHNILKNKSNRLSLPKF

SEQ ID NO: 3395245 - protein, 52 aa, Plasmodium falciparum
VKNISQLRRYISLFHKFIIYHTLPHNISLRKQLFIIEALEWSSFFSGAASEK

SEQ ID NO: 3395246 - protein, 25 aa, Plasmodium falciparum
VKNKTVHYFNLVLIPSIPAQNITEC

SEQ ID NO: 3395247 - protein, 25 aa, Plasmodium falciparum
VKNLKKFIHTWANKYATGLRKGKKY

SEQ ID NO: 3395248 - protein, 21 aa, Plasmodium falciparum
VKNLTCIYNELLKNENIEEMI

SEQ ID NO: 3395249 - protein, 24 aa, Plasmodium falciparum
VKNNIGFVMFKTFEDFKEEIFLFL

SEQ ID NO: 3395250 - protein, 25 aa, Plasmodium falciparum
VKNNTYFYLKYIKYSMRPFRGKLIG

SEQ ID NO: 3395251 - protein, 26 aa, Plasmodium falciparum
VKRFFIPYIRIFPLKGVINGLDFKPP

SEQ ID NO: 3395252 - protein, 19 aa, Plasmodium falciparum
VKRFHVFKDYAFFINDVKK

SEQ ID NO: 3395253 - protein, 24 aa, Plasmodium falciparum
VKRKINFVRYKSSGGMYYYTQYDN

SEQ ID NO: 3395254 - protein, 17 aa, Plasmodium falciparum
VKRKYTKRKLMASNIQN

SEQ ID NO: 3395255 - protein, 19 aa, Plasmodium falciparum
VKSKTIEFINFEKLPAGQN

SEQ ID NO: 3395256 - protein, 19 aa, Plasmodium falciparum
VKSLTYEIQTILNLTQETQ

SEQ ID NO: 3395257 - protein, 27 aa, Plasmodium falciparum
VKTVAENSWILKQNQLKADKYTCMMRK

SEQ ID NO: 3395258 - protein, 18 aa, Plasmodium falciparum
VKVFRFITLSGVEELVFK

SEQ ID NO: 3395259 - protein, 24 aa, Plasmodium falciparum
VKYYPDKDILIWKIKQFQGQKEYI

SEQ ID NO: 3395260 - protein, 18 aa, Plasmodium falciparum
VLAIYMSSYMSDDKCRFF

SEQ ID NO: 3395261 - protein, 22 aa, Plasmodium falciparum
VLCGLYRRLKLLKGVCIAFYGL

SEQ ID NO: 3395262 - protein, 17 aa, Plasmodium falciparum
VLCSKRGVLPIIGILYI

SEQ ID NO: 3395263 - protein, 19 aa, Plasmodium falciparum
VLCVLHEYYQTSLFTEHCI

SEQ ID NO: 3395264 - protein, 25 aa, Plasmodium falciparum
VLCVNKLLNLLNDKYSYLFEYNEQQ

SEQ ID NO: 3395265 - protein, 25 aa, Plasmodium falciparum
VLDDHVLTFFLPINDNPFYIVKVIS

SEQ ID NO: 3395266 - protein, 25 aa, Plasmodium falciparum
VLDDNLNLLPFYYHDDMEYENDTNE

SEQ ID NO: 3395267 - protein, 19 aa, Plasmodium falciparum
VLDILHILLLCECSIFSYD

SEQ ID NO: 3395268 - protein, 22 aa, Plasmodium falciparum
VLDLTLIDLPGLTKVPVGNQPQ

SEQ ID NO: 3395269 - protein, 32 aa, Plasmodium falciparum
VLECEYIINKILLYKNKFLIATYHNGYFSRIR

SEQ ID NO: 3395270 - protein, 20 aa, Plasmodium falciparum
VLEKPFFNDLLINSNFLNCV

SEQ ID NO: 3395271 - protein, 18 aa, Plasmodium falciparum
VLENLCYFDLSYKYYLQK

SEQ ID NO: 3395272 - protein, 32 aa, Plasmodium falciparum
VLEQNTFRQLITKYFTPIIMKKYNMKKKEAFK

SEQ ID NO: 3395273 - protein, 23 aa, Plasmodium falciparum
VLFLSSLFCKSPFNSTVYKTRHS

SEQ ID NO: 3395274 - protein, 24 aa, Plasmodium falciparum
VLGIDKMSMLPYDDLNHAILDIYN

SEQ ID NO: 3395275 - protein, 18 aa, Plasmodium falciparum
VLGIKVKIMLPTAIDTRT

SEQ ID NO: 3395276 - protein, 27 aa, Plasmodium falciparum
VLGKSDLYNLIKWRYKIKKSVLNQTSK

SEQ ID NO: 3395277 - protein, 20 aa, Plasmodium falciparum
VLHDYLFHLNIDYTSFLYKN

SEQ ID NO: 3395278 - protein, 29 aa, Plasmodium falciparum
VLHIINNCQFLIFKGLMTISSLDINKREN

SEQ ID NO: 3395279 - protein, 34 aa, Plasmodium falciparum
VLIITQNIYLCKQLYIYILSIYPTLNVCILSDEK

SEQ ID NO: 3395280 - protein, 25 aa, Plasmodium falciparum
VLIMGKPLLIHLFEQIAICKKFNEK

SEQ ID NO: 3395281 - protein, 17 aa, Plasmodium falciparum
VLIPPRRRHLCTRPITA

SEQ ID NO: 3395282 - protein, 18 aa, Plasmodium falciparum
VLIYIFQTASYYTKSLTG

SEQ ID NO: 3395283 - protein, 36 aa, Plasmodium falciparum
VLKDCPIILHIYGPPYNQILTKYPFLKLIHSNNNNN

SEQ ID NO: 3395284 - protein, 23 aa, Plasmodium falciparum
VLKKIVEIYQWKNVFDLIEIIKY

SEQ ID NO: 3395285 - protein, 17 aa, Plasmodium falciparum
VLKLYLKISKFIEEYKN

SEQ ID NO: 3395286 - protein, 26 aa, Plasmodium falciparum
VLKNAHILSQLFLKSLKVGINASDIT

SEQ ID NO: 3395287 - protein, 18 aa, Plasmodium falciparum
VLKNDFTVSYVKKSVSPG

SEQ ID NO: 3395288 - protein, 26 aa, Plasmodium falciparum
VLKNICLYNYYQILYMINKYNNNENI

SEQ ID NO: 3395289 - protein, 28 aa, Plasmodium falciparum
VLKNKNNIYRNSFSNFATFNYNDSNLSF

SEQ ID NO: 3395290 - protein, 25 aa, Plasmodium falciparum
VLKSPILSNILLWAQAKAQVELKKK

SEQ ID NO: 3395291 - protein, 23 aa, Plasmodium falciparum
VLKTKLLKKSFTPNFEKKTGSIV

SEQ ID NO: 3395292 - protein, 28 aa, Plasmodium falciparum
VLLCNSKFLNVIIFKLLRKKLEKEILKI

SEQ ID NO: 3395293 - protein, 26 aa, Plasmodium falciparum
VLLGYTKILLQKRKKIKIILMSATFD

SEQ ID NO: 3395294 - protein, 19 aa, Plasmodium falciparum
VLLSMYKKKMAIYFRSFVY

SEQ ID NO: 3395295 - protein, 21 aa, Plasmodium falciparum
VLNEFAIKCKTLDTKLIVSIL

SEQ ID NO: 3395296 - protein, 22 aa, Plasmodium falciparum
VLNFYLKWMNKWNNIFDLAKCN

SEQ ID NO: 3395297 - protein, 19 aa, Plasmodium falciparum
VLNKLIKYIINNEIKKKSK

SEQ ID NO: 3395298 - protein, 28 aa, Plasmodium falciparum
VLNLKMMNTHIYDLYSDKSTYNVYNTKM

SEQ ID NO: 3395299 - protein, 20 aa, Plasmodium falciparum
VLNNLLCENILYDFLKDLTA

SEQ ID NO: 3395300 - protein, 22 aa, Plasmodium falciparum
VLNSLLLGSFCNLLWNDNIYTH

SEQ ID NO: 3395301 - protein, 25 aa, Plasmodium falciparum
VLNSWAPYIFISLNPKIIKNLDITH

SEQ ID NO: 3395302 - protein, 26 aa, Plasmodium falciparum
VLNYESIIDQILKKGNLNYSDINKLY

SEQ ID NO: 3395303 - protein, 23 aa, Plasmodium falciparum
VLPNIHNVLLPKKSQLKAGTANQ

SEQ ID NO: 3395304 - protein, 25 aa, Plasmodium falciparum
VLRKINILKEFDHKFLSPGMVNINI

SEQ ID NO: 3395305 - protein, 26 aa, Plasmodium falciparum
VLRKNLYEYMPFQKNEKYFYFKEGHM

SEQ ID NO: 3395306 - protein, 17 aa, Plasmodium falciparum
VLRLSWLDNKTGKEITN

SEQ ID NO: 3395307 - protein, 35 aa, Plasmodium falciparum
VLRNVIQQFRLLKELVIKIINIITLIISICPYNNE

SEQ ID NO: 3395308 - protein, 24 aa, Plasmodium falciparum
VLRRKEIIFWYDEDIVLNNILKIK

SEQ ID NO: 3395309 - protein, 19 aa, Plasmodium falciparum
VLRSLIRTVGRISQFFDEY

SEQ ID NO: 3395310 - protein, 24 aa, Plasmodium falciparum
VLRVSPIQLLITNLNFVCDKCKCI

SEQ ID NO: 3395311 - protein, 18 aa, Plasmodium falciparum
VLSFYKDIGYPYTISKST

SEQ ID NO: 3395312 - protein, 45 aa, Plasmodium falciparum
VLSKFGYIMKFDLSQYFPLLTTKKLFLRGIIEELLWFIRGETNGN

SEQ ID NO: 3395313 - protein, 35 aa, Plasmodium falciparum
VLSQAFPCYLDPYPVSKYGIYGAVPIYVIKKTLLE

SEQ ID NO: 3395314 - protein, 24 aa, Plasmodium falciparum
VLVDNGMLVFLFPVQLDTIQEEIN

SEQ ID NO: 3395315 - protein, 17 aa, Plasmodium falciparum
VLVDVDLFPNVSENYLS

SEQ ID NO: 3395316 - protein, 29 aa, Plasmodium falciparum
VLVSRPSYTFYGYILRPFNEYTNSDTISE

SEQ ID NO: 3395317 - protein, 24 aa, Plasmodium falciparum
VLVTDFYMYSTLNASFNRLNSLKN

SEQ ID NO: 3395318 - protein, 17 aa, Plasmodium falciparum
VLYAFHLKLDYFSTECT

SEQ ID NO: 3395319 - protein, 27 aa, Plasmodium falciparum
VLYIDDLYTYLIRQLYILFCSLEVRKK

SEQ ID NO: 3395320 - protein, 22 aa, Plasmodium falciparum
VLYKMFKSLRRHEDDKFINGSI

SEQ ID NO: 3395321 - protein, 28 aa, Plasmodium falciparum
VLYKQLQHVIFWLDDWSCSRSYGLGTYM

SEQ ID NO: 3395322 - protein, 20 aa, Plasmodium falciparum
VLYSKYFPTIINNNLIKYSK

SEQ ID NO: 3395323 - protein, 18 aa, Plasmodium falciparum
VLYTYPSLNKYIYNNFFR

SEQ ID NO: 3395324 - protein, 17 aa, Plasmodium falciparum
VMDMHFVPNLSFGPPVI

SEQ ID NO: 3395325 - protein, 34 aa, Plasmodium falciparum
VMEILEKYNNYLKLRNYIIPKNMYTISCDHKNDN

SEQ ID NO: 3395326 - protein, 24 aa, Plasmodium falciparum
VMKFLELWNIFKKPQYLIDETIEI

SEQ ID NO: 3395327 - protein, 23 aa, Plasmodium falciparum
VMKFSKFCVYPDFLHACNKNRNK

SEQ ID NO: 3395328 - protein, 23 aa, Plasmodium falciparum
VMKRKPYYKPGIYTQPFLINYVA

SEQ ID NO: 3395329 - protein, 18 aa, Plasmodium falciparum
VMLLSLIYENLLINTICK

SEQ ID NO: 3395330 - protein, 29 aa, Plasmodium falciparum
VMMNKEIIMTLRIPYLKNYKSTTFTNFNH

SEQ ID NO: 3395331 - protein, 31 aa, Plasmodium falciparum
VMNKRLCANFLTTFYLLKKNGKNKNKMALDV

SEQ ID NO: 3395332 - protein, 24 aa, Plasmodium falciparum
VMRKSFHIVFPNKDKYIGKIYILP

SEQ ID NO: 3395333 - protein, 44 aa, Plasmodium falciparum
VNDKSGFFFIFNTIYFTHLKNFYYFVDILNILNYIGKNKSIINT

SEQ ID NO: 3395334 - protein, 24 aa, Plasmodium falciparum
VNDPLSMLVVIKYIEELMKRENVK

SEQ ID NO: 3395335 - protein, 23 aa, Plasmodium falciparum
VNDVFLLYNAIYKLLDVYLRNDN

SEQ ID NO: 3395336 - protein, 27 aa, Plasmodium falciparum
VNEKLPHVVLIFGPFLYIRNFSETIQK

SEQ ID NO: 3395337 - protein, 23 aa, Plasmodium falciparum
VNEKQYDRILKRRLRKVKQDIDR

SEQ ID NO: 3395338 - protein, 29 aa, Plasmodium falciparum
VNERIKYITKQFFLFLRQAERLAIENKAD

SEQ ID NO: 3395339 - protein, 38 aa, Plasmodium falciparum
VNESYAPLYYTVIKKPMYINKIIFRCKKKKYNSLNSFF

SEQ ID NO: 3395340 - protein, 24 aa, Plasmodium falciparum
VNEYNIMRILFHPNVVCLIDSFRV

SEQ ID NO: 3395341 - protein, 19 aa, Plasmodium falciparum
VNFCYGKDYRHISRELERI

SEQ ID NO: 3395342 - protein, 17 aa, Plasmodium falciparum
VNFKYKNDKRYKKKKNR

SEQ ID NO: 3395343 - protein, 18 aa, Plasmodium falciparum
VNFVLKYNFYENKNIYVS

SEQ ID NO: 3395344 - protein, 28 aa, Plasmodium falciparum
VNGSLLKEPYNLHYFLLGTNNPSCENEI

SEQ ID NO: 3395345 - protein, 17 aa, Plasmodium falciparum
VNHKLLSEFLKNSNNTH

SEQ ID NO: 3395346 - protein, 18 aa, Plasmodium falciparum
VNHLNDSIEFKKNNRRIN

SEQ ID NO: 3395347 - protein, 19 aa, Plasmodium falciparum
VNIEFVCAHFLYSNKREII

SEQ ID NO: 3395348 - protein, 27 aa, Plasmodium falciparum
VNIELHSLFTYVRTKLKKKNKDSFKNT

SEQ ID NO: 3395349 - protein, 29 aa, Plasmodium falciparum
VNIENHGLFNLLFDIYGFNKDIFKEYLVH

SEQ ID NO: 3395350 - protein, 29 aa, Plasmodium falciparum
VNIENTHWSLVLIYFPFNDDENKKRDSLH

SEQ ID NO: 3395351 - protein, 26 aa, Plasmodium falciparum
VNIEYVYDLFYPFQKYICPYNNINTN

SEQ ID NO: 3395352 - protein, 18 aa, Plasmodium falciparum
VNIILKRKSLNKNYGVIL

SEQ ID NO: 3395353 - protein, 38 aa, Plasmodium falciparum
VNKDIITKGLGIYPLLAKPLLHRLIKENIIKEKFIKNK

SEQ ID NO: 3395354 - protein, 24 aa, Plasmodium falciparum
VNKFSFAHNYRYLYIAIGNEMRHG

SEQ ID NO: 3395355 - protein, 23 aa, Plasmodium falciparum
VNKKEPFFALKNNSIRHIPKENN

SEQ ID NO: 3395356 - protein, 32 aa, Plasmodium falciparum
VNKKIDIPINLPVPYIVPKPKIIDVDVPVFKF

SEQ ID NO: 3395357 - protein, 25 aa, Plasmodium falciparum
VNKKSFLISTAIKLFRSKAQVSCVA

SEQ ID NO: 3395358 - protein, 17 aa, Plasmodium falciparum
VNKKYLNKFYNKNVRLV

SEQ ID NO: 3395359 - protein, 18 aa, Plasmodium falciparum
VNKNLNMLGIRDSIYKID

SEQ ID NO: 3395360 - protein, 28 aa, Plasmodium falciparum
VNKNVGPYAIYAHVLFSTPEEAKRCLKQ

SEQ ID NO: 3395361 - protein, 52 aa, Plasmodium falciparum
VNKSLLFVLEIFNKKRLDFKIHPKFFHIPNKSILPLCSIRLLQINDAMKFTK

SEQ ID NO: 3395362 - protein, 37 aa, Plasmodium falciparum
VNKTDIICKFFLNAVENKQYGWFWVCPNGGDNCKYKH

SEQ ID NO: 3395363 - protein, 26 aa, Plasmodium falciparum
VNLECPPPLIVPYPVQRIKQISPVMV

SEQ ID NO: 3395364 - protein, 24 aa, Plasmodium falciparum
VNLKNLININKNFNVLMNNINVDQ

SEQ ID NO: 3395365 - protein, 26 aa, Plasmodium falciparum
VNLSNNFILNNFSNILKKLQRMEEDK

SEQ ID NO: 3395366 - protein, 23 aa, Plasmodium falciparum
VNLTKRLICYERYLKAIPKIERR

SEQ ID NO: 3395367 - protein, 55 aa, Plasmodium falciparum
VNMCNYNFNSCKIISLLFYNRILKCVIFKNKMNLIHFYDELLQYLMLNNKMDILK

SEQ ID NO: 3395368 - protein, 18 aa, Plasmodium falciparum
VNMKTWLFVLSEKMFRTD

SEQ ID NO: 3395369 - protein, 25 aa, Plasmodium falciparum
VNMRLPKSEILNQASRLPKLQGMFF

SEQ ID NO: 3395370 - protein, 39 aa, Plasmodium falciparum
VNNIIYPTVYTLWKFPKMIPCFVIYPPASEFLLRGADLM

SEQ ID NO: 3395371 - protein, 27 aa, Plasmodium falciparum
VNNVNSFIWLQYMRYYWDSKKKENKIN

SEQ ID NO: 3395372 - protein, 26 aa, Plasmodium falciparum
VNPPKYINNLVTPSKFPLSGENDDFM

SEQ ID NO: 3395373 - protein, 27 aa, Plasmodium falciparum
VNPSVLKIFSFFDLEEGYFLYDVKSIH

SEQ ID NO: 3395374 - protein, 22 aa, Plasmodium falciparum
VNRKRIIIEKLVLENFKSYSGV

SEQ ID NO: 3395375 - protein, 26 aa, Plasmodium falciparum
VNRNKRLLQIGLFDHLRKAKDALEQE

SEQ ID NO: 3395376 - protein, 26 aa, Plasmodium falciparum
VNSFFIKYYFKYYLNKFFNLNKMFIQ

SEQ ID NO: 3395377 - protein, 18 aa, Plasmodium falciparum
VNSKLMNLFNVLNNFNEN

SEQ ID NO: 3395378 - protein, 30 aa, Plasmodium falciparum
VNSNNGDILFFYFCGYSIKLIDSKFTENYN

SEQ ID NO: 3395379 - protein, 24 aa, Plasmodium falciparum
VNSRNVCYALKNGKFRLINQNGIN

SEQ ID NO: 3395380 - protein, 17 aa, Plasmodium falciparum
VNSVSMSGILFKPGEYL

SEQ ID NO: 3395381 - protein, 33 aa, Plasmodium falciparum
VNTEILRKYISDVKNYLLIKPSLNKNNNNNNNN

SEQ ID NO: 3395382 - protein, 33 aa, Plasmodium falciparum
VNTKTDFIELYTFKYIFAKSTLDYITCRMDDIG

SEQ ID NO: 3395383 - protein, 25 aa, Plasmodium falciparum
VNTLNEKWKLLPAYLKVKGLVKQHI

SEQ ID NO: 3395384 - protein, 25 aa, Plasmodium falciparum
VNVIYKLLNIIKKYNIPFVINNDDN

SEQ ID NO: 3395385 - protein, 28 aa, Plasmodium falciparum
VNVSDYKNWTPLHIAITKMHKDITELLL

SEQ ID NO: 3395386 - protein, 17 aa, Plasmodium falciparum
VNYDIIKRLIYDDSKKY

SEQ ID NO: 3395387 - protein, 49 aa, Plasmodium falciparum
VNYIITIGIWEMYTYEWVFNRKTFLYYHTLLEKYYFYDKNNNLTLFNEK

SEQ ID NO: 3395388 - protein, 18 aa, Plasmodium falciparum
VNYILLPSLPRSNNLKDN

SEQ ID NO: 3395389 - protein, 24 aa, Plasmodium falciparum
VNYKNKSILLPLHKIDDGYEENIQ

SEQ ID NO: 3395390 - protein, 29 aa, Plasmodium falciparum
VNYNSKIYEFLKNILFKTIIVKSLESCEN

SEQ ID NO: 3395391 - protein, 30 aa, Plasmodium falciparum
VPEVNKNYLRFLFLQLLKKRFIKKCKYFNE

SEQ ID NO: 3395392 - protein, 26 aa, Plasmodium falciparum
VPFEEKEIFSLYKKCSYELNEIRKNL

SEQ ID NO: 3395393 - protein, 18 aa, Plasmodium falciparum
VPGFETCQKLFYSFGSRS

SEQ ID NO: 3395394 - protein, 18 aa, Plasmodium falciparum
VPGLLKKLFNVDGSGLAI

SEQ ID NO: 3395395 - protein, 25 aa, Plasmodium falciparum
VPGTFPPDFLLMNAHKYVNSQPVPM

SEQ ID NO: 3395396 - protein, 18 aa, Plasmodium falciparum
VPGVLFIDEVHMLDIECF

SEQ ID NO: 3395397 - protein, 17 aa, Plasmodium falciparum
VPIYVPTPIGPPKDIHV

SEQ ID NO: 3395398 - protein, 20 aa, Plasmodium falciparum
VPKFLKKLSNHIFITGKYID

SEQ ID NO: 3395399 - protein, 22 aa, Plasmodium falciparum
VPKIMVQERIIPVPKKIVKEKI

SEQ ID NO: 3395400 - protein, 24 aa, Plasmodium falciparum
VPKNNPLDFLKDTEYDYLFAEQTN

SEQ ID NO: 3395401 - protein, 25 aa, Plasmodium falciparum
VPKNSFLNVIIFYSPQKKNLVQSEI

SEQ ID NO: 3395402 - protein, 29 aa, Plasmodium falciparum
VPKRDILNYTYVFIRLGDINLLNHFFFEA

SEQ ID NO: 3395403 - protein, 22 aa, Plasmodium falciparum
VPLSNIYLYKNNKLKLIPYLEN

SEQ ID NO: 3395404 - protein, 52 aa, Plasmodium falciparum
VPMFLRSENKRIFFSFFSYFMPKNDLNFIFEHFDIGLIVLTKIHNIRKKYEE

SEQ ID NO: 3395405 - protein, 27 aa, Plasmodium falciparum
VPMYHFFYEHFFYILNIKKGKENVILQ

SEQ ID NO: 3395406 - protein, 30 aa, Plasmodium falciparum
VPPPFYEYPYMMNYPYCNNVLYNGGMDNHP

SEQ ID NO: 3395407 - protein, 19 aa, Plasmodium falciparum
VPRVQLLPFFISSNYLYKN

SEQ ID NO: 3395408 - protein, 21 aa, Plasmodium falciparum
VPRYVEKIIEVPFKPNGEMPK

SEQ ID NO: 3395409 - protein, 25 aa, Plasmodium falciparum
VPSDLYNIIQFFMFDYEMNGYITVE

SEQ ID NO: 3395410 - protein, 19 aa, Plasmodium falciparum
VPSTRYGHISFIHGNNLFI

SEQ ID NO: 3395411 - protein, 18 aa, Plasmodium falciparum
VPYYVPRYVEKIIEVPFK

SEQ ID NO: 3395412 - protein, 23 aa, Plasmodium falciparum
VQDIMCDVFLIIKIRKKRKNYHQ

SEQ ID NO: 3395413 - protein, 22 aa, Plasmodium falciparum
VQDIPFIPLLLIGDFNSTPHID

SEQ ID NO: 3395414 - protein, 26 aa, Plasmodium falciparum
VQEKYEYLMNYLIKLKSSIHNDGISD

SEQ ID NO: 3395415 - protein, 22 aa, Plasmodium falciparum
VQENGVLDFYNSSNLIIKEENE

SEQ ID NO: 3395416 - protein, 25 aa, Plasmodium falciparum
VQGILRRDKIILIPQVEVTDVVIPK

SEQ ID NO: 3395417 - protein, 31 aa, Plasmodium falciparum
VQIKNIHILTPYYWPEAYNFFKYATTPFENV

SEQ ID NO: 3395418 - protein, 23 aa, Plasmodium falciparum
VQILLNYVCNFLPSPKEINNYGY

SEQ ID NO: 3395419 - protein, 24 aa, Plasmodium falciparum
VQINYRLKYIGLNLHKKLLNTKSS

SEQ ID NO: 3395420 - protein, 18 aa, Plasmodium falciparum
VQISKLLKRIMNSSNKNS

SEQ ID NO: 3395421 - protein, 19 aa, Plasmodium falciparum
VQIYIKIVDNKYITWTKNV

SEQ ID NO: 3395422 - protein, 17 aa, Plasmodium falciparum
VQIYRLVTKDSIEQTIL

SEQ ID NO: 3395423 - protein, 22 aa, Plasmodium falciparum
VQKFWQLWNRLPQPSDLLAQRS

SEQ ID NO: 3395424 - protein, 28 aa, Plasmodium falciparum
VQKIHNTNFFFPHFVSYELKNFCYELCS

SEQ ID NO: 3395425 - protein, 19 aa, Plasmodium falciparum
VQKINDLKVKILEKIKGCY

SEQ ID NO: 3395426 - protein, 28 aa, Plasmodium falciparum
VQKMKGKYFPVVSLLERTLNVLAMKVVD

SEQ ID NO: 3395427 - protein, 25 aa, Plasmodium falciparum
VQLEALEFWPIFIKDRSYVAYASYN

SEQ ID NO: 3395428 - protein, 18 aa, Plasmodium falciparum
VQLFYAFVKIEYYPYFFN

SEQ ID NO: 3395429 - protein, 26 aa, Plasmodium falciparum
VQLNELLFTIYCFCKFFKKYHYFDIK

SEQ ID NO: 3395430 - protein, 28 aa, Plasmodium falciparum
VQLPKGLFYFKWSYFIRYKNRKIIFSSD

SEQ ID NO: 3395431 - protein, 17 aa, Plasmodium falciparum
VQNEFNRYFMNNNNYMV

SEQ ID NO: 3395432 - protein, 23 aa, Plasmodium falciparum
VQNHNILLNNYTYNQVYYNLQNY

SEQ ID NO: 3395433 - protein, 25 aa, Plasmodium falciparum
VQNNDLMFYIQLKDKLEASKQAFLE

SEQ ID NO: 3395434 - protein, 25 aa, Plasmodium falciparum
VQNNQSYVIPYYYNNRHNINSSTSL

SEQ ID NO: 3395435 - protein, 29 aa, Plasmodium falciparum
VQNRIYEKRYTPIYINKYEWCGLKLKDIR

SEQ ID NO: 3395436 - protein, 24 aa, Plasmodium falciparum
VQSNFKVYLYTSSLLKINILSHLC

SEQ ID NO: 3395437 - protein, 30 aa, Plasmodium falciparum
VQSNKFRKLLFSLFWFHSILNNRKKFDNLG

SEQ ID NO: 3395438 - protein, 18 aa, Plasmodium falciparum
VQTLLKAGVLVRLINIIN

SEQ ID NO: 3395439 - protein, 18 aa, Plasmodium falciparum
VQYKLSPLYIYNLCTYAL

SEQ ID NO: 3395440 - protein, 37 aa, Plasmodium falciparum
VRGEHDNFFNDFMLFRNMYQQIFNPSFRAADAEVHFT

SEQ ID NO: 3395441 - protein, 20 aa, Plasmodium falciparum
VRGIYFLYRNIMYIKINEDY

SEQ ID NO: 3395442 - protein, 27 aa, Plasmodium falciparum
VRGRLRQPSFRPFYRGRGAYKKIVTNP

SEQ ID NO: 3395443 - protein, 25 aa, Plasmodium falciparum
VRHEPQLMPLKPPYMLSLQKKRQEV

SEQ ID NO: 3395444 - protein, 18 aa, Plasmodium falciparum
VRILPKIRQLSYGYNGIM

SEQ ID NO: 3395445 - protein, 29 aa, Plasmodium falciparum
VRILTTDKCSWLYDYYRITKTSDPCVKEL

SEQ ID NO: 3395446 - protein, 20 aa, Plasmodium falciparum
VRIPLVYFRSANNFLLMFQI

SEQ ID NO: 3395447 - protein, 19 aa, Plasmodium falciparum
VRKGAHGVVFSAWRSENVD

SEQ ID NO: 3395448 - protein, 30 aa, Plasmodium falciparum
VRKSAKQCKARWYEWLDPSVRKTEWNKEEE

SEQ ID NO: 3395449 - protein, 19 aa, Plasmodium falciparum
VRMNTCRICLFSGSIFKHP

SEQ ID NO: 3395450 - protein, 17 aa, Plasmodium falciparum
VRMYDGGFLNDNRIRVF

SEQ ID NO: 3395451 - protein, 25 aa, Plasmodium falciparum
VRSIKMDIFTDEQLKYIDKGGNKKC

SEQ ID NO: 3395452 - protein, 25 aa, Plasmodium falciparum
VRTRGVYQAYKLAAEFRNRILENNK

SEQ ID NO: 3395453 - protein, 23 aa, Plasmodium falciparum
VRVKMLAIMLGLHNVPFVKIKDK

SEQ ID NO: 3395454 - protein, 17 aa, Plasmodium falciparum
VRVKYRDSKLTHLLKNS

SEQ ID NO: 3395455 - protein, 38 aa, Plasmodium falciparum
VSCGKRIIGFLSASGKIYCWHLNELNDFDKNVPYLLVD

SEQ ID NO: 3395456 - protein, 24 aa, Plasmodium falciparum
VSDIFNLKMFLSTDLLIDNTNDIP

SEQ ID NO: 3395457 - protein, 19 aa, Plasmodium falciparum
VSDLLYKKGIDLNNNRFLI

SEQ ID NO: 3395458 - protein, 23 aa, Plasmodium falciparum
VSDRFNGFLTNNKKPVIPNMLNI

SEQ ID NO: 3395459 - protein, 18 aa, Plasmodium falciparum
VSDTLFYKDKYWGRNLSK

SEQ ID NO: 3395460 - protein, 28 aa, Plasmodium falciparum
VSDVTDLHYLSHLVFRVWERKHLKRDDS

SEQ ID NO: 3395461 - protein, 28 aa, Plasmodium falciparum
VSEADQLMRIFRILGTPNSKNWPNVTEL

SEQ ID NO: 3395462 - protein, 17 aa, Plasmodium falciparum
VSEDYFMSINNLKDIYS

SEQ ID NO: 3395463 - protein, 28 aa, Plasmodium falciparum
VSENKNIYFNLFFGKKSKKNNNNNNNNI

SEQ ID NO: 3395464 - protein, 24 aa, Plasmodium falciparum
VSGEKLLYLLRSLGIYLNKTESEV

SEQ ID NO: 3395465 - protein, 18 aa, Plasmodium falciparum
VSGKLRAQRAKSMKFRDG

SEQ ID NO: 3395466 - protein, 18 aa, Plasmodium falciparum
VSICKKYVKIWNMNNLQN

SEQ ID NO: 3395467 - protein, 26 aa, Plasmodium falciparum
VSIERYKRLIFRRIKWNEDVYDDEEN

SEQ ID NO: 3395468 - protein, 22 aa, Plasmodium falciparum
VSIIKPQLFIPIKEIKLHVQEI

SEQ ID NO: 3395469 - protein, 27 aa, Plasmodium falciparum
VSINSKMAIFYVYNHLIQELRNNLKND

SEQ ID NO: 3395470 - protein, 37 aa, Plasmodium falciparum
VSIYTLYNHINYFNKLLFVWSYIDLLEIILKECLDIP

SEQ ID NO: 3395471 - protein, 22 aa, Plasmodium falciparum
VSKIIKRFILNTNKTAFIVEHD

SEQ ID NO: 3395472 - protein, 23 aa, Plasmodium falciparum
VSKISTIYIYKTYTYELLYVLKS

SEQ ID NO: 3395473 - protein, 23 aa, Plasmodium falciparum
VSKLVQKYLALPSNENIMATDYL

SEQ ID NO: 3395474 - protein, 24 aa, Plasmodium falciparum
VSLKNNLLFVPLINIKKTLHDLIF

SEQ ID NO: 3395475 - protein, 21 aa, Plasmodium falciparum
VSMPKYWHFIRLMGRSPSHEV

SEQ ID NO: 3395476 - protein, 17 aa, Plasmodium falciparum
VSNILEALSLLLKYDIT

SEQ ID NO: 3395477 - protein, 27 aa, Plasmodium falciparum
VSNKEELIYYIKILNHLGSYDETVTLI

SEQ ID NO: 3395478 - protein, 23 aa, Plasmodium falciparum
VSNLFITKYISVYFYHIIEKKME

SEQ ID NO: 3395479 - protein, 19 aa, Plasmodium falciparum
VSPPKLRFLSKIYHPNIYS

SEQ ID NO: 3395480 - protein, 32 aa, Plasmodium falciparum
VSQFHNKNYIPTFQDIFITKSCPTIATVAFKN

SEQ ID NO: 3395481 - protein, 18 aa, Plasmodium falciparum
VSRKFFFQIIDIATNKNI

SEQ ID NO: 3395482 - protein, 26 aa, Plasmodium falciparum
VSSKVYLMDLWWNPAIEDQAFERVHR

SEQ ID NO: 3395483 - protein, 17 aa, Plasmodium falciparum
VSSMNFEYPFNISKMNT

SEQ ID NO: 3395484 - protein, 25 aa, Plasmodium falciparum
VSSVHISTYLFTFKTREERESWQNN

SEQ ID NO: 3395485 - protein, 26 aa, Plasmodium falciparum
VSSVVKKYFLYTYAKNFITDTFINMD

SEQ ID NO: 3395486 - protein, 29 aa, Plasmodium falciparum
VSSYIPLRKINIITNKIMCTILNSCCIHD

SEQ ID NO: 3395487 - protein, 25 aa, Plasmodium falciparum
VSTHHAILSLLLLNYSFDKINEYMD

SEQ ID NO: 3395488 - protein, 28 aa, Plasmodium falciparum
VSTNENWHLYIIFPGSPIFNQFCNNNNL

SEQ ID NO: 3395489 - protein, 26 aa, Plasmodium falciparum
VSTSNLMWLERALYTWKSTNPKYYDM

SEQ ID NO: 3395490 - protein, 18 aa, Plasmodium falciparum
VSVRNHKIIKPRNIIKMW

SEQ ID NO: 3395491 - protein, 20 aa, Plasmodium falciparum
VSYFDFRNHMKSYYYDKMSE

SEQ ID NO: 3395492 - protein, 27 aa, Plasmodium falciparum
VSYTSKPFMLPIYNNPNNMFTRAQKFY

SEQ ID NO: 3395493 - protein, 36 aa, Plasmodium falciparum
VTCFQRGLLLKQLFNYNIMLLFEYHKLVKSSLAFNL

SEQ ID NO: 3395494 - protein, 24 aa, Plasmodium falciparum
VTEHIWTYILKKDTFLIKQKWPSP

SEQ ID NO: 3395495 - protein, 25 aa, Plasmodium falciparum
VTGHTYVLYGPLLNGITTVIFSSIP

SEQ ID NO: 3395496 - protein, 26 aa, Plasmodium falciparum
VTHCILRVDVPLKRGSKNEERKSSSY

SEQ ID NO: 3395497 - protein, 32 aa, Plasmodium falciparum
VTIFDTIDNFPYLIVTLRSLVRVIKPEQTDAL

SEQ ID NO: 3395498 - protein, 29 aa, Plasmodium falciparum
VTIPYDFVIPLYTVLPKSIGPFLLNYKVN

SEQ ID NO: 3395499 - protein, 25 aa, Plasmodium falciparum
VTKEYWLYRDLYGSSYQPWLMYNEK

SEQ ID NO: 3395500 - protein, 37 aa, Plasmodium falciparum
VTKIILNIVWKKNYFEWIDILYLLKMWNINKEQFIDA

SEQ ID NO: 3395501 - protein, 27 aa, Plasmodium falciparum
VTKPDWDMWFIPPKLLEDLKQGVKRFF

SEQ ID NO: 3395502 - protein, 23 aa, Plasmodium falciparum
VTLKLLYNLLKINNFHFENIHNI

SEQ ID NO: 3395503 - protein, 19 aa, Plasmodium falciparum
VTLNSCFHSFCWKCLATAI

SEQ ID NO: 3395504 - protein, 27 aa, Plasmodium falciparum
VTNELNIPITWISPIGLPCEQPYRLGN

SEQ ID NO: 3395505 - protein, 34 aa, Plasmodium falciparum
VTNEPRPPLVINPPPANIIFKNKSPQPIYVNSTR

SEQ ID NO: 3395506 - protein, 24 aa, Plasmodium falciparum
VTNGKPVNLKSGAAVTHCILRVDV

SEQ ID NO: 3395507 - protein, 18 aa, Plasmodium falciparum
VTNKLLTKKMGFPVTNKL

SEQ ID NO: 3395508 - protein, 19 aa, Plasmodium falciparum
VTNKRYKKGLHKNGIHEND

SEQ ID NO: 3395509 - protein, 24 aa, Plasmodium falciparum
VTNNYGFVFFPPNIYDKTIYSLYI

SEQ ID NO: 3395510 - protein, 25 aa, Plasmodium falciparum
VTPGMPVPWPIPTTTQQLGSTTQST

SEQ ID NO: 3395511 - protein, 23 aa, Plasmodium falciparum
VTPKSYLSFIDLYKQMYVKKYDE

SEQ ID NO: 3395512 - protein, 17 aa, Plasmodium falciparum
VTQVYSLIEKTLCDHIE

SEQ ID NO: 3395513 - protein, 32 aa, Plasmodium falciparum
VTSNTIKLIFNKYIHILYIIEKCMCSNTPCYF

SEQ ID NO: 3395514 - protein, 24 aa, Plasmodium falciparum
VTSQILFHRFYFKKSFTDFDVNII

SEQ ID NO: 3395515 - protein, 45 aa, Plasmodium falciparum
VTSVCSLRIKLWEALLLYVNNLNVEFIYFIISCLKEIEVYWGQEA

SEQ ID NO: 3395516 - protein, 24 aa, Plasmodium falciparum
VTTEKHFPIYASKLPQNNGANLCL

SEQ ID NO: 3395517 - protein, 33 aa, Plasmodium falciparum
VTTLIQKINKFYYYFKEFLLKEKYNTKDDANKK

SEQ ID NO: 3395518 - protein, 20 aa, Plasmodium falciparum
VTVIRALLTPQPLKELRIKN

SEQ ID NO: 3395519 - protein, 18 aa, Plasmodium falciparum
VTVVDLHNYIAVFGPCLS

SEQ ID NO: 3395520 - protein, 37 aa, Plasmodium falciparum
VTVVTGLHPYIKLEKMAKIFSKFYACGSSVIKGANNN

SEQ ID NO: 3395521 - protein, 26 aa, Plasmodium falciparum
VVASWVIGLGLLSYPYNKSPSIQSRS

SEQ ID NO: 3395522 - protein, 22 aa, Plasmodium falciparum
VVDHILNYRLPKKYLKDADKNE

SEQ ID NO: 3395523 - protein, 19 aa, Plasmodium falciparum
VVDIYFFNYFQLNYKYKLL

SEQ ID NO: 3395524 - protein, 22 aa, Plasmodium falciparum
VVDLFCGVGYFTLPLLKCIEAQ

SEQ ID NO: 3395525 - protein, 20 aa, Plasmodium falciparum
VVEKEKIIHIPKIEYRNKIV

SEQ ID NO: 3395526 - protein, 17 aa, Plasmodium falciparum
VVENPNDAVLLFEEVRK

SEQ ID NO: 3395527 - protein, 29 aa, Plasmodium falciparum
VVGHMLYKEKLIGPYLVIVPQSTVDNWLN

SEQ ID NO: 3395528 - protein, 17 aa, Plasmodium falciparum
VVGRDLKDIKTLNKILL

SEQ ID NO: 3395529 - protein, 35 aa, Plasmodium falciparum
VVHMNIHCYTYFLMWSSQIIILKKGKPELSEFFFD

SEQ ID NO: 3395530 - protein, 23 aa, Plasmodium falciparum
VVIDPLYIAQWGTMWIMMRREKR

SEQ ID NO: 3395531 - protein, 38 aa, Plasmodium falciparum
VVISLEFLNFCVKNLGLFFARFIDESFMKKISKLLRTT

SEQ ID NO: 3395532 - protein, 19 aa, Plasmodium falciparum
VVLYFYLKEKSKLTNMSFI

SEQ ID NO: 3395533 - protein, 27 aa, Plasmodium falciparum
VVNLYYSIIFYVYYTNKNKILQTVNYF

SEQ ID NO: 3395534 - protein, 43 aa, Plasmodium falciparum
VVNSIRFEDNTNIKIPVFLKNSPLYVLYPELNSYIKDTLIKND

SEQ ID NO: 3395535 - protein, 35 aa, Plasmodium falciparum
VVNTSERRILFYKTKICPWYIKGKCERRKTCLYAH

SEQ ID NO: 3395536 - protein, 19 aa, Plasmodium falciparum
VVNYKTLRRLINREFIEKT

SEQ ID NO: 3395537 - protein, 24 aa, Plasmodium falciparum
VVPEVKDGYSVIHLSRACLNNPEH

SEQ ID NO: 3395538 - protein, 19 aa, Plasmodium falciparum
VVQRKLRKSIEVGKVAIIL

SEQ ID NO: 3395539 - protein, 17 aa, Plasmodium falciparum
VVRNLMLNTQDQNFVLN

SEQ ID NO: 3395540 - protein, 25 aa, Plasmodium falciparum
VVSYFTSCFLYKWKNYFQKEMLYAP

SEQ ID NO: 3395541 - protein, 18 aa, Plasmodium falciparum
VVTYEDGDVEWITPSFLF

SEQ ID NO: 3395542 - protein, 19 aa, Plasmodium falciparum
VVTYFRYLLFLNESNKVLI

SEQ ID NO: 3395543 - protein, 19 aa, Plasmodium falciparum
VVYCYLKLLKLKNICTPNG

SEQ ID NO: 3395544 - protein, 18 aa, Plasmodium falciparum
VVYIFDKHLYIRYDNLSI

SEQ ID NO: 3395545 - protein, 46 aa, Plasmodium falciparum
VVYKYVEGLAWVLAYYFQSCPMWHWYYPYYYAPLSSDLIVDNITFN

SEQ ID NO: 3395546 - protein, 27 aa, Plasmodium falciparum
VVYRHFATLYFVFIIDSMESELGILDL

SEQ ID NO: 3395547 - protein, 18 aa, Plasmodium falciparum
VWDMRYNKESLLKLKYHT

SEQ ID NO: 3395548 - protein, 32 aa, Plasmodium falciparum
VWENDNYDIFPSYYKEIFKYFKELRSNMSKIY

SEQ ID NO: 3395549 - protein, 17 aa, Plasmodium falciparum
VWHAMLCGYISKNKNEN

SEQ ID NO: 3395550 - protein, 25 aa, Plasmodium falciparum
VWKDPTLDEWPENDFRIFCGNLGNE

SEQ ID NO: 3395551 - protein, 18 aa, Plasmodium falciparum
VWKRFNIKNNIKTIIHNE

SEQ ID NO: 3395552 - protein, 25 aa, Plasmodium falciparum
VYDDFYYIISIFNPILKYISKYKDK

SEQ ID NO: 3395553 - protein, 24 aa, Plasmodium falciparum
VYDEYPLFIGYSRKRFIAHCMNDQ

SEQ ID NO: 3395554 - protein, 25 aa, Plasmodium falciparum
VYDYKNLIHIFNNINLKLININNIF

SEQ ID NO: 3395555 - protein, 17 aa, Plasmodium falciparum
VYEPLPWESFLKGLDES

SEQ ID NO: 3395556 - protein, 17 aa, Plasmodium falciparum
VYFIKNNEKYKLLTTIL

SEQ ID NO: 3395557 - protein, 18 aa, Plasmodium falciparum
VYHNVRKDFYILNTKNKS

SEQ ID NO: 3395558 - protein, 25 aa, Plasmodium falciparum
VYIEYEKEFIARIKTSKIFEKNNKQ

SEQ ID NO: 3395559 - protein, 18 aa, Plasmodium falciparum
VYIFNNLKRKLFNSQILK

SEQ ID NO: 3395560 - protein, 23 aa, Plasmodium falciparum
VYINNNYFFNIRKNDDNYYIEKS

SEQ ID NO: 3395561 - protein, 34 aa, Plasmodium falciparum
VYKKIYFFPCIDIINFWYIIKRINIYSIKDLSSL

SEQ ID NO: 3395562 - protein, 27 aa, Plasmodium falciparum
VYKSLKKAFFFFKRLKNILKRFGISMK

SEQ ID NO: 3395563 - protein, 25 aa, Plasmodium falciparum
VYKYFKYKIIFSKKKKRYLNDTFPY

SEQ ID NO: 3395564 - protein, 27 aa, Plasmodium falciparum
VYLKNYNFILLFYSLSNYLFHHIFKEK

SEQ ID NO: 3395565 - protein, 18 aa, Plasmodium falciparum
VYLSYIHCNLYNADHIFF

SEQ ID NO: 3395566 - protein, 25 aa, Plasmodium falciparum
VYNFPYINLLNNKFLLSLCYNYIPI

SEQ ID NO: 3395567 - protein, 24 aa, Plasmodium falciparum
VYNHLEPILFDYRKIRMRLQNGTF

SEQ ID NO: 3395568 - protein, 17 aa, Plasmodium falciparum
VYNISCMNVLNIIEAFE

SEQ ID NO: 3395569 - protein, 18 aa, Plasmodium falciparum
VYNKIKNKIFFSRNNLRK

SEQ ID NO: 3395570 - protein, 17 aa, Plasmodium falciparum
VYNLNFVRLTLLEIANI

SEQ ID NO: 3395571 - protein, 23 aa, Plasmodium falciparum
VYNMTFHIPIYIIDTIQHEGYEN

SEQ ID NO: 3395572 - protein, 32 aa, Plasmodium falciparum
VYNNNNCYYYYNYVLPYTLNLDKKYINNYNFP

SEQ ID NO: 3395573 - protein, 18 aa, Plasmodium falciparum
VYNPSHNMLLYYTDIMKN

SEQ ID NO: 3395574 - protein, 28 aa, Plasmodium falciparum
VYPNMSYNRLISYLTLYNSIKKKMKLIN

SEQ ID NO: 3395575 - protein, 23 aa, Plasmodium falciparum
VYSDIDYILHFQTLIKVIDREIN

SEQ ID NO: 3395576 - protein, 17 aa, Plasmodium falciparum
VYSFYKSYYGPNDMNTI

SEQ ID NO: 3395577 - protein, 23 aa, Plasmodium falciparum
VYSIHDTFFYKGVQFKIMGIDPV

SEQ ID NO: 3395578 - protein, 29 aa, Plasmodium falciparum
VYSRNDFGLFIFLIQYTENDFFSNMYEDS

SEQ ID NO: 3395579 - protein, 17 aa, Plasmodium falciparum
WAQKKECLYLTIELQDI

SEQ ID NO: 3395580 - protein, 25 aa, Plasmodium falciparum
WASKEEEFLFKKNLTMIHFNNNDER

SEQ ID NO: 3395581 - protein, 25 aa, Plasmodium falciparum
WCGFKKRWFVLRNNKLYYYKNEKSL

SEQ ID NO: 3395582 - protein, 24 aa, Plasmodium falciparum
WCINKKLLYTLPTYENNKYIKFKK

SEQ ID NO: 3395583 - protein, 18 aa, Plasmodium falciparum
WCMNPDQGLIKPDVVFYL

SEQ ID NO: 3395584 - protein, 33 aa, Plasmodium falciparum
WCYCVNKFFDSKFWKFVLQIINFDKIYDPRCAL

SEQ ID NO: 3395585 - protein, 17 aa, Plasmodium falciparum
WCYVEVQLLGKGSRDWD

SEQ ID NO: 3395586 - protein, 18 aa, Plasmodium falciparum
WDGIYFGLSRMQVELDYK

SEQ ID NO: 3395587 - protein, 23 aa, Plasmodium falciparum
WDHSVRLWDLSLGETIRSFIGHT

SEQ ID NO: 3395588 - protein, 18 aa, Plasmodium falciparum
WDILVKYFSNYYLVKYKK

SEQ ID NO: 3395589 - protein, 22 aa, Plasmodium falciparum
WDKLSELGIIEFLSVPKDFKEN

SEQ ID NO: 3395590 - protein, 32 aa, Plasmodium falciparum
WDLKKWQPVIEDRFFLEWLVNIPSNEEAERKG

SEQ ID NO: 3395591 - protein, 21 aa, Plasmodium falciparum
WDLVMNMMIGIRISSIKKFSI

SEQ ID NO: 3395592 - protein, 29 aa, Plasmodium falciparum
WDPSCHYMSLIFLYIKNLFYLQEEYNKET

SEQ ID NO: 3395593 - protein, 17 aa, Plasmodium falciparum
WECGIFHLIIHFSEEYP

SEQ ID NO: 3395594 - protein, 24 aa, Plasmodium falciparum
WEIELKRFCPCFKILSYYGNQNER

SEQ ID NO: 3395595 - protein, 20 aa, Plasmodium falciparum
WEKINITYNRLLNLKRDDFS

SEQ ID NO: 3395596 - protein, 18 aa, Plasmodium falciparum
WEPFENLSPNLKGQARKV

SEQ ID NO: 3395597 - protein, 17 aa, Plasmodium falciparum
WEYETFPFFTYKSNYLM

SEQ ID NO: 3395598 - protein, 22 aa, Plasmodium falciparum
WFDLEKLNLIKILNTKLISCMN

SEQ ID NO: 3395599 - protein, 19 aa, Plasmodium falciparum
WFNVIELKKVYIFSKGRVS

SEQ ID NO: 3395600 - protein, 17 aa, Plasmodium falciparum
WFRVDPNLNWKEKQQLI

SEQ ID NO: 3395601 - protein, 18 aa, Plasmodium falciparum
WGIDIQGNLKRWNKYEWI

SEQ ID NO: 3395602 - protein, 25 aa, Plasmodium falciparum
WGLDDFQFLVFLFGAAQLSYNRKIK

SEQ ID NO: 3395603 - protein, 32 aa, Plasmodium falciparum
WGNLAKNNLIWYKLFTKVFLGNFKKGNINWFV

SEQ ID NO: 3395604 - protein, 19 aa, Plasmodium falciparum
WGQVFILDALVLYEPKTSK

SEQ ID NO: 3395605 - protein, 29 aa, Plasmodium falciparum
WGSEDYKPYLPLPFVDFPPGLTPAQLDQF

SEQ ID NO: 3395606 - protein, 22 aa, Plasmodium falciparum
WGTVTSAFWLKYPNNIQKHIQN

SEQ ID NO: 3395607 - protein, 25 aa, Plasmodium falciparum
WISEFNRWCPSLNVITYRGNKLERK

SEQ ID NO: 3395608 - protein, 26 aa, Plasmodium falciparum
WISQNYFDNFFSNYYLYNFGTIEGTY

SEQ ID NO: 3395609 - protein, 21 aa, Plasmodium falciparum
WKCPICSFYLRPKNLVIDTFI

SEQ ID NO: 3395610 - protein, 19 aa, Plasmodium falciparum
WKFNFSKGKNLFNNKFFNV

SEQ ID NO: 3395611 - protein, 23 aa, Plasmodium falciparum
WKIPPCVSNWKNNKGYNIPLDKR

SEQ ID NO: 3395612 - protein, 28 aa, Plasmodium falciparum
WKIRDDIYWNIPLPYWVMSKNLLEELKK

SEQ ID NO: 3395613 - protein, 29 aa, Plasmodium falciparum
WKLCNFKIMFIAYKWTLGVSFAELLEQCE

SEQ ID NO: 3395614 - protein, 20 aa, Plasmodium falciparum
WKMNETDMHLIIDPPSMTEM

SEQ ID NO: 3395615 - protein, 30 aa, Plasmodium falciparum
WKNCKLLHSFYIYLSYYKNILNYKINIDNI

SEQ ID NO: 3395616 - protein, 19 aa, Plasmodium falciparum
WKNDIEHLKIWKPKKNYKF

SEQ ID NO: 3395617 - protein, 26 aa, Plasmodium falciparum
WKNISYNCIDIIYYLIHENNKKNNKM

SEQ ID NO: 3395618 - protein, 17 aa, Plasmodium falciparum
WKRVINLFKKVYSDISG

SEQ ID NO: 3395619 - protein, 17 aa, Plasmodium falciparum
WKSEEQTLLEEGLRIYK

SEQ ID NO: 3395620 - protein, 37 aa, Plasmodium falciparum
WKSNIDEWVPFSPEYAYKLLHYANYDPHKAISIMKSS

SEQ ID NO: 3395621 - protein, 18 aa, Plasmodium falciparum
WKTNSGLLYDFVCRKELE

SEQ ID NO: 3395622 - protein, 23 aa, Plasmodium falciparum
WKYLNLVNLIKKMELCQKDLLEY

SEQ ID NO: 3395623 - protein, 18 aa, Plasmodium falciparum
WLDYRHEILRQWNKFLPE

SEQ ID NO: 3395624 - protein, 18 aa, Plasmodium falciparum
WLKIYKIPCIGGIDTRAL

SEQ ID NO: 3395625 - protein, 17 aa, Plasmodium falciparum
WLLNYNKNNLRKIEDNI

SEQ ID NO: 3395626 - protein, 19 aa, Plasmodium falciparum
WLNMKSLEYSLINSGKEPL

SEQ ID NO: 3395627 - protein, 17 aa, Plasmodium falciparum
WLVTRYPKIAKAVYETR

SEQ ID NO: 3395628 - protein, 18 aa, Plasmodium falciparum
WMSPFIKSYNKEFKCHKT

SEQ ID NO: 3395629 - protein, 18 aa, Plasmodium falciparum
WMSTSWINFCSIIKSFRI

SEQ ID NO: 3395630 - protein, 17 aa, Plasmodium falciparum
WNDLSNASIECLENDKS

SEQ ID NO: 3395631 - protein, 17 aa, Plasmodium falciparum
WNIFIEEKNDRFISIQE

SEQ ID NO: 3395632 - protein, 29 aa, Plasmodium falciparum
WNKNGYFFIVSHNFGYFSIFTLNKNSCYK

SEQ ID NO: 3395633 - protein, 30 aa, Plasmodium falciparum
WNKQEIRTFLEKYILYPKNFDKISQYLECK

SEQ ID NO: 3395634 - protein, 27 aa, Plasmodium falciparum
WNPIINLQMLILGLLLLLDEPSTDDPF

SEQ ID NO: 3395635 - protein, 21 aa, Plasmodium falciparum
WNSILSAQKYHFCNKWLSKRS

SEQ ID NO: 3395636 - protein, 27 aa, Plasmodium falciparum
WNVKDKNILCSFKIKKKSCSNWPVINF

SEQ ID NO: 3395637 - protein, 18 aa, Plasmodium falciparum
WNVNNFIFVKPYRINNDH

SEQ ID NO: 3395638 - protein, 17 aa, Plasmodium falciparum
WPKIIFESVRCLKKGAT

SEQ ID NO: 3395639 - protein, 18 aa, Plasmodium falciparum
WQAIYTAGVYLPKPISTA

SEQ ID NO: 3395640 - protein, 20 aa, Plasmodium falciparum
WQKKGFMLEQNREKINIVLN

SEQ ID NO: 3395641 - protein, 17 aa, Plasmodium falciparum
WQPHFHPHNQEFRVRYR

SEQ ID NO: 3395642 - protein, 20 aa, Plasmodium falciparum
WRCWKANIPWKVVGLPLPVE

SEQ ID NO: 3395643 - protein, 20 aa, Plasmodium falciparum
WRDFFIHIYENPQLYDYFNE

SEQ ID NO: 3395644 - protein, 24 aa, Plasmodium falciparum
WREIGEHMFFLWTCAENDMLDLKN

SEQ ID NO: 3395645 - protein, 24 aa, Plasmodium falciparum
WREYKLVFKRYASLFFIACIDKGD

SEQ ID NO: 3395646 - protein, 28 aa, Plasmodium falciparum
WRKNTPFLYSSLLKHKLDWPSLTVEFLG

SEQ ID NO: 3395647 - protein, 20 aa, Plasmodium falciparum
WRTQFNSVFLPYLPAHISRP

SEQ ID NO: 3395648 - protein, 38 aa, Plasmodium falciparum
WRVIEKSHVLFYILDVRNPLFFYCPGLEYYIKKVDKRK

SEQ ID NO: 3395649 - protein, 27 aa, Plasmodium falciparum
WSAACIICELIIGRPLFKGVTEFDLII

SEQ ID NO: 3395650 - protein, 21 aa, Plasmodium falciparum
WSKTDAWVFSSLSYDGKCVVH

SEQ ID NO: 3395651 - protein, 17 aa, Plasmodium falciparum
WSLEGIDASKFSIGLSL

SEQ ID NO: 3395652 - protein, 18 aa, Plasmodium falciparum
WSLGCIMGELLCGKPLFT

SEQ ID NO: 3395653 - protein, 20 aa, Plasmodium falciparum
WSLNQIAHYIKFAGPDDSVF

SEQ ID NO: 3395654 - protein, 26 aa, Plasmodium falciparum
WSQGYISNYIYLDFLNCIGGRSRKDF

SEQ ID NO: 3395655 - protein, 23 aa, Plasmodium falciparum
WTATSGYSFVRFSTNIEARKTLT

SEQ ID NO: 3395656 - protein, 18 aa, Plasmodium falciparum
WTDGVFTGILRKIIYNSS

SEQ ID NO: 3395657 - protein, 19 aa, Plasmodium falciparum
WTESTFEAYLESLNFNSLL

SEQ ID NO: 3395658 - protein, 28 aa, Plasmodium falciparum
WTFKNIIDNPFFQRLRSLSQLGACQYVY

SEQ ID NO: 3395659 - protein, 29 aa, Plasmodium falciparum
WTLEDNKIIHIFIEKLNGMEWWNTVIKGD

SEQ ID NO: 3395660 - protein, 26 aa, Plasmodium falciparum
WTSEQVLRVLSIRKSLKRIGYNINGI

SEQ ID NO: 3395661 - protein, 23 aa, Plasmodium falciparum
WTVKKAIGIFLLIHGLNGHVRLQ

SEQ ID NO: 3395662 - protein, 25 aa, Plasmodium falciparum
WTVKKAIGLIILIHGLTSHMRLAFL

SEQ ID NO: 3395663 - protein, 29 aa, Plasmodium falciparum
WVDDNIYVDVPLTIKQCLLGGLVTVPTLN

SEQ ID NO: 3395664 - protein, 30 aa, Plasmodium falciparum
WVEGYLSYGKWTLPNGIYFVGRFRQNKPTG

SEQ ID NO: 3395665 - protein, 17 aa, Plasmodium falciparum
WVFSSLSYDGKCVVHGV

SEQ ID NO: 3395666 - protein, 27 aa, Plasmodium falciparum
WYDLSKPTLFNILNSLPPPPWDENGPL

SEQ ID NO: 3395667 - protein, 21 aa, Plasmodium falciparum
WYLILLWLYTHNQYKCDLRLK

SEQ ID NO: 3395668 - protein, 24 aa, Plasmodium falciparum
YAAKLLQPNQFPKESFNRIVEMFT

SEQ ID NO: 3395669 - protein, 22 aa, Plasmodium falciparum
YAATKDYLLNLPIEKVQDFETK

SEQ ID NO: 3395670 - protein, 26 aa, Plasmodium falciparum
YADLKKWFVHIPADIKKRVNQIFEKM

SEQ ID NO: 3395671 - protein, 23 aa, Plasmodium falciparum
YADNKEMLYIPKNNINVNNMINN

SEQ ID NO: 3395672 - protein, 20 aa, Plasmodium falciparum
YAFIEFSTYEVAKYCFEKLN

SEQ ID NO: 3395673 - protein, 29 aa, Plasmodium falciparum
YAFQTKQKLYFILEYCPGGELFFHLSKLR

SEQ ID NO: 3395674 - protein, 22 aa, Plasmodium falciparum
YAGIDLTCKYLHLGNLVPLITL

SEQ ID NO: 3395675 - protein, 33 aa, Plasmodium falciparum
YAHDKSELKPIPNLYKTAMCRNFIKNMCFKSKK

SEQ ID NO: 3395676 - protein, 38 aa, Plasmodium falciparum
YAIAELDCRQSQQLLLDLGLYCNGIKLNIEHFKEKKKF

SEQ ID NO: 3395677 - protein, 26 aa, Plasmodium falciparum
YAKDNSTFYILIQKLNILAKKQNNKH

SEQ ID NO: 3395678 - protein, 20 aa, Plasmodium falciparum
YAKKLLMYTLFGEEIIDSNE

SEQ ID NO: 3395679 - protein, 18 aa, Plasmodium falciparum
YAKRLDLNSFDPIKRNEL

SEQ ID NO: 3395680 - protein, 22 aa, Plasmodium falciparum
YALDLICPLSCIITPNFYECKV

SEQ ID NO: 3395681 - protein, 30 aa, Plasmodium falciparum
YALNNKDVFILLKNRILLIAIDEVHCMSEW

SEQ ID NO: 3395682 - protein, 18 aa, Plasmodium falciparum
YAPFLFPQTLGNLAKRDN

SEQ ID NO: 3395683 - protein, 20 aa, Plasmodium falciparum
YAPYNVIPKNIPYVSVNFSL

SEQ ID NO: 3395684 - protein, 21 aa, Plasmodium falciparum
YAQNSIDFLKLSGINFEKHQS

SEQ ID NO: 3395685 - protein, 18 aa, Plasmodium falciparum
YASEIFVLLILRINQFSQ

SEQ ID NO: 3395686 - protein, 30 aa, Plasmodium falciparum
YASFIKKYKGILWLSYFGNYDLGIPCLNIN

SEQ ID NO: 3395687 - protein, 25 aa, Plasmodium falciparum
YASKFFGCLVSLSKLLAWESRDVHK

SEQ ID NO: 3395688 - protein, 17 aa, Plasmodium falciparum
YASKWIRRLQLLNEKYN

SEQ ID NO: 3395689 - protein, 18 aa, Plasmodium falciparum
YAYDFSFFDESDKCMVSL

SEQ ID NO: 3395690 - protein, 27 aa, Plasmodium falciparum
YAYVDVEFPFWFYIKNFINIKEQEYKN

SEQ ID NO: 3395691 - protein, 17 aa, Plasmodium falciparum
YAYVIKIINLKIILTID

SEQ ID NO: 3395692 - protein, 18 aa, Plasmodium falciparum
YCCCCNRKLSYACPVFFI

SEQ ID NO: 3395693 - protein, 24 aa, Plasmodium falciparum
YCDDQYIVTNPLQTRMRNVNVGQN

SEQ ID NO: 3395694 - protein, 32 aa, Plasmodium falciparum
YCDNPKFYFNFPNFVLCNPSFIFSNPSFYHKD

SEQ ID NO: 3395695 - protein, 36 aa, Plasmodium falciparum
YCEHINPCFLISFNVDIDFKLLQPYIENHNIILRNH

SEQ ID NO: 3395696 - protein, 19 aa, Plasmodium falciparum
YCEKKGYIKGLVKDIIHDP

SEQ ID NO: 3395697 - protein, 21 aa, Plasmodium falciparum
YCIFVCVIYYENTFLHKTQLS

SEQ ID NO: 3395698 - protein, 20 aa, Plasmodium falciparum
YCINKLQPCILLLDNIETIC

SEQ ID NO: 3395699 - protein, 22 aa, Plasmodium falciparum
YCKKKLHIWLKVMLVKQKCGYC

SEQ ID NO: 3395700 - protein, 19 aa, Plasmodium falciparum
YCLPEPLRHVHKTFLPCLK

SEQ ID NO: 3395701 - protein, 34 aa, Plasmodium falciparum
YCNASLQLILSIKPLCIYLLKKLKKISFNTKSKY

SEQ ID NO: 3395702 - protein, 27 aa, Plasmodium falciparum
YCNVVNAQILLLFNKYKYINYDIVKNE

SEQ ID NO: 3395703 - protein, 25 aa, Plasmodium falciparum
YCTKEKFILNFFKTFINSLENDNII

SEQ ID NO: 3395704 - protein, 40 aa, Plasmodium falciparum
YCVSTVYYWHVFHHYKFFFVKYIYMKLFDVYSKNKDIFKE

SEQ ID NO: 3395705 - protein, 18 aa, Plasmodium falciparum
YCWVAHNNIYFLAVTRKN

SEQ ID NO: 3395706 - protein, 36 aa, Plasmodium falciparum
YDCDIDNILIPLSIYDYIKSFNKILYKKLRNLCYDV

SEQ ID NO: 3395707 - protein, 22 aa, Plasmodium falciparum
YDCGVFTCMFAKCLSFNREFDF

SEQ ID NO: 3395708 - protein, 18 aa, Plasmodium falciparum
YDDDIYFLVVMKRKIHCF

SEQ ID NO: 3395709 - protein, 25 aa, Plasmodium falciparum
YDDDNLFMDSRLKKKKKKKTALSNL

SEQ ID NO: 3395710 - protein, 28 aa, Plasmodium falciparum
YDDEIAEIYFWSFKLKYLDECILKYYKK

SEQ ID NO: 3395711 - protein, 21 aa, Plasmodium falciparum
YDDICHYNLTWTKECLNRNNK

SEQ ID NO: 3395712 - protein, 17 aa, Plasmodium falciparum
YDDIRILDNISWTILLK

SEQ ID NO: 3395713 - protein, 31 aa, Plasmodium falciparum
YDDKTYSYEKFLLKNFFSKISKFISSNNVED

SEQ ID NO: 3395714 - protein, 20 aa, Plasmodium falciparum
YDDMLYAIEKFDGAEFKVYD

SEQ ID NO: 3395715 - protein, 19 aa, Plasmodium falciparum
YDDVIKCYMDYTMHGMEDE

SEQ ID NO: 3395716 - protein, 28 aa, Plasmodium falciparum
YDEANKCFRIKINGYRKAYSVIRRGVKE

SEQ ID NO: 3395717 - protein, 26 aa, Plasmodium falciparum
YDEEREIQVFIDISKLLQSKEDNDGN

SEQ ID NO: 3395718 - protein, 25 aa, Plasmodium falciparum
YDEFEKRNLLRFSFVKNAEENKRND

SEQ ID NO: 3395719 - protein, 25 aa, Plasmodium falciparum
YDEIDNIYFHPPKGSHIKIKFKSMI

SEQ ID NO: 3395720 - protein, 26 aa, Plasmodium falciparum
YDEKKEWRKYIKGLALISPMISIEKQ

SEQ ID NO: 3395721 - protein, 20 aa, Plasmodium falciparum
YDEYIYLYEKSQLVWQQKML

SEQ ID NO: 3395722 - protein, 28 aa, Plasmodium falciparum
YDEYKYLKEDLFLSDSHFYKLKRNEEYV

SEQ ID NO: 3395723 - protein, 18 aa, Plasmodium falciparum
YDEYLNLYKQNEGNKKTE

SEQ ID NO: 3395724 - protein, 19 aa, Plasmodium falciparum
YDFLLAETRLSEIHANKII

SEQ ID NO: 3395725 - protein, 19 aa, Plasmodium falciparum
YDFYVYYKNLLASEKRKKE

SEQ ID NO: 3395726 - protein, 17 aa, Plasmodium falciparum
YDGDILRYLTMSEFLQI

SEQ ID NO: 3395727 - protein, 19 aa, Plasmodium falciparum
YDGDLLFTTGRDKKFILWR

SEQ ID NO: 3395728 - protein, 32 aa, Plasmodium falciparum
YDHCYNFFYVNDLIYFRHYQILPVTLADSNNV

SEQ ID NO: 3395729 - protein, 19 aa, Plasmodium falciparum
YDHILKDAVYYNNGNYIKG

SEQ ID NO: 3395730 - protein, 29 aa, Plasmodium falciparum
YDHIRNYVKYVYLPLKKIENRSFYPEMPS

SEQ ID NO: 3395731 - protein, 26 aa, Plasmodium falciparum
YDHSCGQKYLLPNLNLNNDLSIQFDG

SEQ ID NO: 3395732 - protein, 17 aa, Plasmodium falciparum
YDIDWFFLVIDEAHRIK

SEQ ID NO: 3395733 - protein, 20 aa, Plasmodium falciparum
YDIELSKIEKFGASIGPVFT

SEQ ID NO: 3395734 - protein, 29 aa, Plasmodium falciparum
YDIHIEKLLNLFPRDFMKKYKIVKKLGEG

SEQ ID NO: 3395735 - protein, 17 aa, Plasmodium falciparum
YDIILLRYSYEVIYFYK

SEQ ID NO: 3395736 - protein, 30 aa, Plasmodium falciparum
YDIKILKCPLVTKSYYLWGSLYVVNQMKEN

SEQ ID NO: 3395737 - protein, 20 aa, Plasmodium falciparum
YDINHVYLLYCFDKKLEACR

SEQ ID NO: 3395738 - protein, 24 aa, Plasmodium falciparum
YDISGCYILRPAAYYIWECVQAFF

SEQ ID NO: 3395739 - protein, 21 aa, Plasmodium falciparum
YDITMNSFYDIYKNIYHNGVE

SEQ ID NO: 3395740 - protein, 29 aa, Plasmodium falciparum
YDIVTSKLYFFDILSVQWKEYNEDTFNDG

SEQ ID NO: 3395741 - protein, 35 aa, Plasmodium falciparum
YDKFKELLDERTLLFKLIIYYKNINYNYKQHIDKI

SEQ ID NO: 3395742 - protein, 25 aa, Plasmodium falciparum
YDKHFKNFFLLLTEYVNNNIDEYAH

SEQ ID NO: 3395743 - protein, 23 aa, Plasmodium falciparum
YDKHYPYLAELRKRLVDKLSNLK

SEQ ID NO: 3395744 - protein, 17 aa, Plasmodium falciparum
YDKNAVKGNMNLIGKHS

SEQ ID NO: 3395745 - protein, 23 aa, Plasmodium falciparum
YDKNKMYNFLYDDLNTIDKMNET

SEQ ID NO: 3395746 - protein, 20 aa, Plasmodium falciparum
YDKNSLLIKIKDNDSVIDSD

SEQ ID NO: 3395747 - protein, 25 aa, Plasmodium falciparum
YDKNTYIYYDNKYTFHKTNSFINDE

SEQ ID NO: 3395748 - protein, 20 aa, Plasmodium falciparum
YDKQELLKHLSLNNTNVSDT

SEQ ID NO: 3395749 - protein, 25 aa, Plasmodium falciparum
YDKQMDKIYILKKSSEHTRTSKDNS

SEQ ID NO: 3395750 - protein, 18 aa, Plasmodium falciparum
YDKRFIFYLNEKDNEKNK

SEQ ID NO: 3395751 - protein, 30 aa, Plasmodium falciparum
YDKYIEKINKLYLNIKNKKFIYDLENMKNG

SEQ ID NO: 3395752 - protein, 17 aa, Plasmodium falciparum
YDKYLELIYNLYSYMNI

SEQ ID NO: 3395753 - protein, 23 aa, Plasmodium falciparum
YDLNGLVKIFLKNKKIVNCYDVD

SEQ ID NO: 3395754 - protein, 18 aa, Plasmodium falciparum
YDLQQLVCKIKELEKSKE

SEQ ID NO: 3395755 - protein, 45 aa, Plasmodium falciparum
YDNFLSHLSSYIFDDSYFIIPFFTSYGKFLIIIKTNKNIDNLQQS

SEQ ID NO: 3395756 - protein, 19 aa, Plasmodium falciparum
YDNIFKRFLVYHYKQGIQV

SEQ ID NO: 3395757 - protein, 23 aa, Plasmodium falciparum
YDNKYYCCLLVLREFFSMTEGPL

SEQ ID NO: 3395758 - protein, 28 aa, Plasmodium falciparum
YDNKYYYLADIFGYINRIYVLYNNNKNI

SEQ ID NO: 3395759 - protein, 26 aa, Plasmodium falciparum
YDNLNNLIFNSYYDNDLTLNVNDMNQ

SEQ ID NO: 3395760 - protein, 19 aa, Plasmodium falciparum
YDNRVIAFGKYPTDSSKEI

SEQ ID NO: 3395761 - protein, 17 aa, Plasmodium falciparum
YDQCFLKLLLGTFKLYM

SEQ ID NO: 3395762 - protein, 26 aa, Plasmodium falciparum
YDQVKKKYYLLNRNVYEKLIYNLKNE

SEQ ID NO: 3395763 - protein, 24 aa, Plasmodium falciparum
YDRDIIYEQIYSLPKKNKPRCLVI

SEQ ID NO: 3395764 - protein, 19 aa, Plasmodium falciparum
YDRHLTIFSPDGNLYQIEY

SEQ ID NO: 3395765 - protein, 24 aa, Plasmodium falciparum
YDSPYFLYACISPNFKYVYCIAED

SEQ ID NO: 3395766 - protein, 24 aa, Plasmodium falciparum
YDTIVVSKKIYYLLNDYKGTNQDT

SEQ ID NO: 3395767 - protein, 24 aa, Plasmodium falciparum
YDTSMHVLELPERKFLNLSEVEDN

SEQ ID NO: 3395768 - protein, 17 aa, Plasmodium falciparum
YDVLVIPGGMKGSNTIS

SEQ ID NO: 3395769 - protein, 18 aa, Plasmodium falciparum
YDWTIRIWTQSRKTSLII

SEQ ID NO: 3395770 - protein, 22 aa, Plasmodium falciparum
YDYLYKIILIGDSGVGKSCILL

SEQ ID NO: 3395771 - protein, 18 aa, Plasmodium falciparum
YDYMDIFKIILNKIQKDK

SEQ ID NO: 3395772 - protein, 18 aa, Plasmodium falciparum
YDYTKIYSFYIPNFYYTD

SEQ ID NO: 3395773 - protein, 18 aa, Plasmodium falciparum
YDYYEKIYIQKENNYFLL

SEQ ID NO: 3395774 - protein, 37 aa, Plasmodium falciparum
YDYYIENNILSDSKFWFFLFNNKYSHLFFYDKNEKDP

SEQ ID NO: 3395775 - protein, 26 aa, Plasmodium falciparum
YEADAQLSYLCRMGFISCAISEDSDL

SEQ ID NO: 3395776 - protein, 31 aa, Plasmodium falciparum
YEAQPYSIIMILGLHFVGFHIRFSKISRGGV

SEQ ID NO: 3395777 - protein, 26 aa, Plasmodium falciparum
YECFKYPRNIITKFYDYIYYMKQKQD

SEQ ID NO: 3395778 - protein, 33 aa, Plasmodium falciparum
YEDKFEEWKKSKLPLILFHETYVLLLHIDNLKL

SEQ ID NO: 3395779 - protein, 24 aa, Plasmodium falciparum
YEDKKLISIVYNRKKIKYDNSLKI

SEQ ID NO: 3395780 - protein, 18 aa, Plasmodium falciparum
YEDLFNFVYHINSIQSIF

SEQ ID NO: 3395781 - protein, 26 aa, Plasmodium falciparum
YEEFDINDIYPYKSPKYKTLIEMVLN

SEQ ID NO: 3395782 - protein, 17 aa, Plasmodium falciparum
YEEIISRSIKRTRYNNY

SEQ ID NO: 3395783 - protein, 30 aa, Plasmodium falciparum
YEEKYEKFWNALLFFCKYYLDKIELKGKEN

SEQ ID NO: 3395784 - protein, 20 aa, Plasmodium falciparum
YEENIILLKKLMRTENIKFD

SEQ ID NO: 3395785 - protein, 25 aa, Plasmodium falciparum
YEEQYFFHKSIHYVMWNNNNIKKFF

SEQ ID NO: 3395786 - protein, 20 aa, Plasmodium falciparum
YEFDNIIYYNLIYSCRHIKN

SEQ ID NO: 3395787 - protein, 18 aa, Plasmodium falciparum
YEFKSFSSLLAQWNVNKC

SEQ ID NO: 3395788 - protein, 17 aa, Plasmodium falciparum
YEFLCDKCSYRSKHKKK

SEQ ID NO: 3395789 - protein, 20 aa, Plasmodium falciparum
YEFTFKKIFILYATFELRQL

SEQ ID NO: 3395790 - protein, 19 aa, Plasmodium falciparum
YEHIFNKKIYELINVWNPL

SEQ ID NO: 3395791 - protein, 18 aa, Plasmodium falciparum
YEHQVYIRKIVIYDDFTN

SEQ ID NO: 3395792 - protein, 35 aa, Plasmodium falciparum
YEIFCVFEKILHYYAPYLYLQNNYIYTINTLNENN

SEQ ID NO: 3395793 - protein, 18 aa, Plasmodium falciparum
YEIKKIMKNIFIALDFFH

SEQ ID NO: 3395794 - protein, 20 aa, Plasmodium falciparum
YEILNKFNRTYCKELYKENH

SEQ ID NO: 3395795 - protein, 17 aa, Plasmodium falciparum
YEINKFDRRETSEYFYL

SEQ ID NO: 3395796 - protein, 33 aa, Plasmodium falciparum
YEINLGLHILKFPDIFYYILKNMLVHKLAEYMY

SEQ ID NO: 3395797 - protein, 21 aa, Plasmodium falciparum
YEINMILKEIDLEGVLLVIFA

SEQ ID NO: 3395798 - protein, 18 aa, Plasmodium falciparum
YEIQYKKKTLRDTNIIEK

SEQ ID NO: 3395799 - protein, 18 aa, Plasmodium falciparum
YEIRDIILPVNIKNAMEK

SEQ ID NO: 3395800 - protein, 28 aa, Plasmodium falciparum
YEKCELYIKVKFKKNAPFLLLSISHQSG

SEQ ID NO: 3395801 - protein, 25 aa, Plasmodium falciparum
YEKDIMNNIKLADKIYKLSTNKSSD

SEQ ID NO: 3395802 - protein, 30 aa, Plasmodium falciparum
YEKDKLVCILKYFYVNKLTGAFSLTYPQFV

SEQ ID NO: 3395803 - protein, 21 aa, Plasmodium falciparum
YEKIMKIMKYLRKVKSKYPEI

SEQ ID NO: 3395804 - protein, 17 aa, Plasmodium falciparum
YEKKCFPCFINKNDISE

SEQ ID NO: 3395805 - protein, 19 aa, Plasmodium falciparum
YEKKFSIHTLTLCLDLFIN

SEQ ID NO: 3395806 - protein, 24 aa, Plasmodium falciparum
YEKKIKLIPKPQWANKYNLKVLLK

SEQ ID NO: 3395807 - protein, 17 aa, Plasmodium falciparum
YEKKYYWNPRENGQYKN

SEQ ID NO: 3395808 - protein, 17 aa, Plasmodium falciparum
YEKLDGLSFCYDNDSKN

SEQ ID NO: 3395809 - protein, 32 aa, Plasmodium falciparum
YEKNKHIFPASKWEIYKPLKTYTTSYTDLFNK

SEQ ID NO: 3395810 - protein, 25 aa, Plasmodium falciparum
YEKNVPAYFLTYGNIINNIISNEEE

SEQ ID NO: 3395811 - protein, 22 aa, Plasmodium falciparum
YEKPDTHKNFWKSFGLNNEAGK

SEQ ID NO: 3395812 - protein, 28 aa, Plasmodium falciparum
YEKPTPIQMQAIPIALEMRDLIGIAETG

SEQ ID NO: 3395813 - protein, 18 aa, Plasmodium falciparum
YEKYINNMSFINNKESSN

SEQ ID NO: 3395814 - protein, 25 aa, Plasmodium falciparum
YELITRLWNRLLDNVFIKDKKQRIN

SEQ ID NO: 3395815 - protein, 35 aa, Plasmodium falciparum
YELKNEYIFVYRCNICLLLFTCVYTFAEHIISENH

SEQ ID NO: 3395816 - protein, 18 aa, Plasmodium falciparum
YELKNYGIALELPQRKNR

SEQ ID NO: 3395817 - protein, 46 aa, Plasmodium falciparum
YELMKGSDFDIFKKYKNFYLNHFININNIFSTIISFHIHNIEDKYK

SEQ ID NO: 3395818 - protein, 18 aa, Plasmodium falciparum
YELTKFISIFFELQKNEP

SEQ ID NO: 3395819 - protein, 20 aa, Plasmodium falciparum
YENGSGCMNILIGKNEHSKE

SEQ ID NO: 3395820 - protein, 20 aa, Plasmodium falciparum
YENIHLLFPQIKIFNDITIT

SEQ ID NO: 3395821 - protein, 26 aa, Plasmodium falciparum
YENILIKIPIHHFIKSVNFHTSLGNI

SEQ ID NO: 3395822 - protein, 19 aa, Plasmodium falciparum
YENIPYNIIPLCVKVLTKP

SEQ ID NO: 3395823 - protein, 41 aa, Plasmodium falciparum
YENKFNIYFNIENIDYPLKFYKTIYFNFFSSFIENEDREYI

SEQ ID NO: 3395824 - protein, 29 aa, Plasmodium falciparum
YENKRKRDFLFFINALRRNDILSYNKKCK

SEQ ID NO: 3395825 - protein, 26 aa, Plasmodium falciparum
YENMKKNFFLFKTLNEDMNTPIKSLN

SEQ ID NO: 3395826 - protein, 24 aa, Plasmodium falciparum
YENNQRIQLYNYPSFETYNNNIIN

SEQ ID NO: 3395827 - protein, 19 aa, Plasmodium falciparum
YENRKYIMKYKNVEYIPIK

SEQ ID NO: 3395828 - protein, 23 aa, Plasmodium falciparum
YENTFFDETLLLNRLNKKKNDGI

SEQ ID NO: 3395829 - protein, 23 aa, Plasmodium falciparum
YENVCLNVKPIIISKQRLESGVP

SEQ ID NO: 3395830 - protein, 25 aa, Plasmodium falciparum
YENVFLYIGIFPYKEYNADILITWN

SEQ ID NO: 3395831 - protein, 21 aa, Plasmodium falciparum
YENVKIILIINCIDKLIMDLR

SEQ ID NO: 3395832 - protein, 27 aa, Plasmodium falciparum
YENVNIFKLLALFGWSYKSPQDDEHTQ

SEQ ID NO: 3395833 - protein, 28 aa, Plasmodium falciparum
YENYNILKNDLFLYDIEKNTWTQIFTMD

SEQ ID NO: 3395834 - protein, 19 aa, Plasmodium falciparum
YEPKKETCKFFFKKGKCIH

SEQ ID NO: 3395835 - protein, 17 aa, Plasmodium falciparum
YEQALIHLQFNSDLWFS

SEQ ID NO: 3395836 - protein, 36 aa, Plasmodium falciparum
YEQIMNYIYNGKLKSYWLPGFFNPQGFLTSMKQEIT

SEQ ID NO: 3395837 - protein, 30 aa, Plasmodium falciparum
YEQNNTLLSLLSFICNNISPYVGAYAAKKI

SEQ ID NO: 3395838 - protein, 21 aa, Plasmodium falciparum
YEQPEILLENIFLSSNSIEEL

SEQ ID NO: 3395839 - protein, 23 aa, Plasmodium falciparum
YEQRNWKCIARELNTNRSPLSCF

SEQ ID NO: 3395840 - protein, 33 aa, Plasmodium falciparum
YERLKDAILYYNEFLRLINMFKIIVIDDYLYEE

SEQ ID NO: 3395841 - protein, 30 aa, Plasmodium falciparum
YESELFHGLAWLKYCFHILNFKRNMTEKEK

SEQ ID NO: 3395842 - protein, 36 aa, Plasmodium falciparum
YESENFYKKCFKIKCLYNYYYILKDDINVEIKNEEE

SEQ ID NO: 3395843 - protein, 33 aa, Plasmodium falciparum
YESIKRRFHFLYNIKLYEYIYSFHIRKNLKLFC

SEQ ID NO: 3395844 - protein, 26 aa, Plasmodium falciparum
YESKFEYELFLLRQKYHDLYGPIYDK

SEQ ID NO: 3395845 - protein, 32 aa, Plasmodium falciparum
YESKKRLQNIKEFYLYNFLNSKKEEKDINDIK

SEQ ID NO: 3395846 - protein, 34 aa, Plasmodium falciparum
YESRRICFIGFLNNYHCQCFKKFFNNTYINTSKI

SEQ ID NO: 3395847 - protein, 22 aa, Plasmodium falciparum
YESTLTIILLQQLRNFCILLNK

SEQ ID NO: 3395848 - protein, 17 aa, Plasmodium falciparum
YESYICLSVIKNVIKEN

SEQ ID NO: 3395849 - protein, 23 aa, Plasmodium falciparum
YETNKYDIFLNQETIMNKNKLNT

SEQ ID NO: 3395850 - protein, 18 aa, Plasmodium falciparum
YEVDILTEYVWHMAGNAK

SEQ ID NO: 3395851 - protein, 25 aa, Plasmodium falciparum
YEVFCFFCKYYYNKDLLGERKKEIR

SEQ ID NO: 3395852 - protein, 20 aa, Plasmodium falciparum
YEYDEKFGQFNKKIKEMEER

SEQ ID NO: 3395853 - protein, 17 aa, Plasmodium falciparum
YEYGSFIMMGFLNDNNS

SEQ ID NO: 3395854 - protein, 29 aa, Plasmodium falciparum
YEYNIHIELSLYQKILYKQIQTKGFKQVN

SEQ ID NO: 3395855 - protein, 17 aa, Plasmodium falciparum
YEYPNNVFKHCTEKLST

SEQ ID NO: 3395856 - protein, 43 aa, Plasmodium falciparum
YEYVDLKNIFFMKGLIHFSFQVIYTLLYLKHFTTTAPLLSSDE

SEQ ID NO: 3395857 - protein, 17 aa, Plasmodium falciparum
YFDIYINSDIINIFHVN

SEQ ID NO: 3395858 - protein, 20 aa, Plasmodium falciparum
YFDLDLFKYLSTLTERDEEK

SEQ ID NO: 3395859 - protein, 26 aa, Plasmodium falciparum
YFDNVGLPFLAFCFYNINYEPTKKKQ

SEQ ID NO: 3395860 - protein, 28 aa, Plasmodium falciparum
YFDSARKLWRCQWKENGKFKTKGFSLIH

SEQ ID NO: 3395861 - protein, 17 aa, Plasmodium falciparum
YFEFLKIHIMNKSTKNK

SEQ ID NO: 3395862 - protein, 18 aa, Plasmodium falciparum
YFEKLIQEYPKRSDLWFT

SEQ ID NO: 3395863 - protein, 17 aa, Plasmodium falciparum
YFESAIDYYTKAIQYDN

SEQ ID NO: 3395864 - protein, 18 aa, Plasmodium falciparum
YFEVLFSVLYGGGTIMFP

SEQ ID NO: 3395865 - protein, 18 aa, Plasmodium falciparum
YFFNKNHFWYFSGKNDII

SEQ ID NO: 3395866 - protein, 33 aa, Plasmodium falciparum
YFFTRSMDNTIKYWDLRNLHLCLHTIQDVPTIY

SEQ ID NO: 3395867 - protein, 26 aa, Plasmodium falciparum
YFFVLDKNYTCFIPIQVIKCIIKSVL

SEQ ID NO: 3395868 - protein, 28 aa, Plasmodium falciparum
YFHKILNEIFFLIYLKNKNIILIEKIFW

SEQ ID NO: 3395869 - protein, 18 aa, Plasmodium falciparum
YFIAHYLDIFIPSLSHKI

SEQ ID NO: 3395870 - protein, 19 aa, Plasmodium falciparum
YFICKHIEIIYFNMNLFLI

SEQ ID NO: 3395871 - protein, 18 aa, Plasmodium falciparum
YFIKLQLLNDIQIHENFK

SEQ ID NO: 3395872 - protein, 17 aa, Plasmodium falciparum
YFILFDVVGTLIDSVNI

SEQ ID NO: 3395873 - protein, 30 aa, Plasmodium falciparum
YFKEERTYIYIHKVYILKCLIRKENKKNIS

SEQ ID NO: 3395874 - protein, 17 aa, Plasmodium falciparum
YFKFIRAPYERWQFCAT

SEQ ID NO: 3395875 - protein, 25 aa, Plasmodium falciparum
YFKKNIMYFIQKYIILKKYLITEEH

SEQ ID NO: 3395876 - protein, 19 aa, Plasmodium falciparum
YFLNLLFDRIKLNKLKMHY

SEQ ID NO: 3395877 - protein, 18 aa, Plasmodium falciparum
YFLNSYIDKNLDPISHDN

SEQ ID NO: 3395878 - protein, 30 aa, Plasmodium falciparum
YFLTGHNNCIYIWNLSLLTNTIIMNKLKDQ

SEQ ID NO: 3395879 - protein, 17 aa, Plasmodium falciparum
YFLVKSYIKNIKSLCYE

SEQ ID NO: 3395880 - protein, 22 aa, Plasmodium falciparum
YFNAVLQFLTSFDDLGNFLRSY

SEQ ID NO: 3395881 - protein, 17 aa, Plasmodium falciparum
YFNDIYVKKKGKCDDMK

SEQ ID NO: 3395882 - protein, 18 aa, Plasmodium falciparum
YFNFIPSCERVAKMNSGK

SEQ ID NO: 3395883 - protein, 18 aa, Plasmodium falciparum
YFNGWLLCPPSNKYILLC

SEQ ID NO: 3395884 - protein, 18 aa, Plasmodium falciparum
YFNIRLNNRKIATKGWNW

SEQ ID NO: 3395885 - protein, 17 aa, Plasmodium falciparum
YFNNIILLLLEKLEIND

SEQ ID NO: 3395886 - protein, 17 aa, Plasmodium falciparum
YFNNINHFAYRNNSNIT

SEQ ID NO: 3395887 - protein, 24 aa, Plasmodium falciparum
YFNPLNNCILFKNDLSIIISQGPF

SEQ ID NO: 3395888 - protein, 19 aa, Plasmodium falciparum
YFNVPYDIFVVFVENFHME

SEQ ID NO: 3395889 - protein, 17 aa, Plasmodium falciparum
YFPCLMIAEKQYNSLKE

SEQ ID NO: 3395890 - protein, 41 aa, Plasmodium falciparum
YFPDINFFEDIKRAPYFLTKFFTFAQSYLNFTSNIYRFINF

SEQ ID NO: 3395891 - protein, 17 aa, Plasmodium falciparum
YFPTIINNNLIKYSKED

SEQ ID NO: 3395892 - protein, 17 aa, Plasmodium falciparum
YFQAIFSTLLNNAQAKL

SEQ ID NO: 3395893 - protein, 21 aa, Plasmodium falciparum
YFQDVLSNMKYTQKDDFLFKE

SEQ ID NO: 3395894 - protein, 30 aa, Plasmodium falciparum
YFQNLLREEGITPQNFLGFLNNRNINNPLG

SEQ ID NO: 3395895 - protein, 41 aa, Plasmodium falciparum
YFREEFKYFISLDTPFFNIYDFLFFTISPLSRFILSEENQI

SEQ ID NO: 3395896 - protein, 18 aa, Plasmodium falciparum
YFRHLSIYALQVKNKSIQ

SEQ ID NO: 3395897 - protein, 18 aa, Plasmodium falciparum
YFRNGGILKYVLRSLVNE

SEQ ID NO: 3395898 - protein, 26 aa, Plasmodium falciparum
YFRSANNFLLMFQINAMIILEERLNT

SEQ ID NO: 3395899 - protein, 26 aa, Plasmodium falciparum
YFSDMMVYISWVPKSARCQYPRELPK

SEQ ID NO: 3395900 - protein, 25 aa, Plasmodium falciparum
YFSEKKFLMKNFKNVKYNFKKSHSS

SEQ ID NO: 3395901 - protein, 17 aa, Plasmodium falciparum
YFSFELTGLIKHIGSGT

SEQ ID NO: 3395902 - protein, 20 aa, Plasmodium falciparum
YFSIFTLNKNSCYKFTLREQ

SEQ ID NO: 3395903 - protein, 36 aa, Plasmodium falciparum
YFSNYSTYEYPLTHLLNFNKECAYALNYNENLFKDN

SEQ ID NO: 3395904 - protein, 18 aa, Plasmodium falciparum
YFYDIRNEKWHNILSTSS

SEQ ID NO: 3395905 - protein, 22 aa, Plasmodium falciparum
YFYEEFSPFYLFHEQPKNSIEE

SEQ ID NO: 3395906 - protein, 18 aa, Plasmodium falciparum
YFYKDWNDEIESEFYSEE

SEQ ID NO: 3395907 - protein, 17 aa, Plasmodium falciparum
YFYNNFYDDLRCKSIDT

SEQ ID NO: 3395908 - protein, 20 aa, Plasmodium falciparum
YFYYQNKEEQIKNAYLPFIY

SEQ ID NO: 3395909 - protein, 20 aa, Plasmodium falciparum
YGARDYYIKAGILHIVIGDL

SEQ ID NO: 3395910 - protein, 23 aa, Plasmodium falciparum
YGDHELWPFELDDMIIHIKKHVK

SEQ ID NO: 3395911 - protein, 25 aa, Plasmodium falciparum
YGDVIIIKRMFSSHTSKFYLYGLKK

SEQ ID NO: 3395912 - protein, 30 aa, Plasmodium falciparum
YGEIKDLIVMKSFWRKGQAWVVYDDKECAT

SEQ ID NO: 3395913 - protein, 23 aa, Plasmodium falciparum
YGENKLIYYLQNSYHKFMDVINN

SEQ ID NO: 3395914 - protein, 23 aa, Plasmodium falciparum
YGGFLIFHLRKNYILTPIFRSNK

SEQ ID NO: 3395915 - protein, 18 aa, Plasmodium falciparum
YGGWVAPNIYYLGYSSVH

SEQ ID NO: 3395916 - protein, 49 aa, Plasmodium falciparum
YGHTEYPNLISLKNFKLIFKNYKNIFSSDKIVLFIFNCLDRGKRYHITQ

SEQ ID NO: 3395917 - protein, 24 aa, Plasmodium falciparum
YGHTFISAALYYIQKKKLFHTNKK

SEQ ID NO: 3395918 - protein, 17 aa, Plasmodium falciparum
YGHVLSLKQDLKTRLFF

SEQ ID NO: 3395919 - protein, 30 aa, Plasmodium falciparum
YGIKFIHLTNEWFKLYKCELRPLMKICHYP

SEQ ID NO: 3395920 - protein, 28 aa, Plasmodium falciparum
YGINDPFLQVKILKLLKYLNSDHVNNNE

SEQ ID NO: 3395921 - protein, 26 aa, Plasmodium falciparum
YGKDDFWFPNNIIYEYIKTHLLNRFV

SEQ ID NO: 3395922 - protein, 18 aa, Plasmodium falciparum
YGKKSKLNFCCWPSPQVS

SEQ ID NO: 3395923 - protein, 30 aa, Plasmodium falciparum
YGKNKPFGGLILIKPKFLNIISNISVINNE

SEQ ID NO: 3395924 - protein, 17 aa, Plasmodium falciparum
YGKQFFVFNAFKRDIKF

SEQ ID NO: 3395925 - protein, 25 aa, Plasmodium falciparum
YGNGENVFFSIFKNAWLSKDNHIID

SEQ ID NO: 3395926 - protein, 27 aa, Plasmodium falciparum
YGNINTNYILFIASGAFQRVKPNDMLN

SEQ ID NO: 3395927 - protein, 17 aa, Plasmodium falciparum
YGNMYLRICLKVLKKNV

SEQ ID NO: 3395928 - protein, 19 aa, Plasmodium falciparum
YGNNLRIGRPKTFPIEYHS

SEQ ID NO: 3395929 - protein, 22 aa, Plasmodium falciparum
YGNNNLCAPTSLLLHNNEKGNT

SEQ ID NO: 3395930 - protein, 26 aa, Plasmodium falciparum
YGPNTFKLHRLPIPKLGQILGLVGTN

SEQ ID NO: 3395931 - protein, 39 aa, Plasmodium falciparum
YGPYNYYDIYNFITTGLVTVLNPILLRRINNKNEVLENI

SEQ ID NO: 3395932 - protein, 34 aa, Plasmodium falciparum
YGQNICFFNSIIQAIIRIPYICKDLLNKLHSINC

SEQ ID NO: 3395933 - protein, 26 aa, Plasmodium falciparum
YGQNWRPEYITDLYFFIKKNYHKMDS

SEQ ID NO: 3395934 - protein, 26 aa, Plasmodium falciparum
YGQTFMYNSYFLKTLLEGSLYEKKLY

SEQ ID NO: 3395935 - protein, 17 aa, Plasmodium falciparum
YGRPVITAFNQNNLISW

SEQ ID NO: 3395936 - protein, 17 aa, Plasmodium falciparum
YGSFLNKEKMNNKIKNH

SEQ ID NO: 3395937 - protein, 19 aa, Plasmodium falciparum
YGSGENFLFTFKNNKLNNN

SEQ ID NO: 3395938 - protein, 26 aa, Plasmodium falciparum
YGSGLWHTWFDRSLGLSGQVLYKKGN

SEQ ID NO: 3395939 - protein, 32 aa, Plasmodium falciparum
YGSKDFRSKWYIHFYKICLYNEKIYGGVTGGN

SEQ ID NO: 3395940 - protein, 24 aa, Plasmodium falciparum
YGSLYVLNFFSKCPSLLLPYNMNN

SEQ ID NO: 3395941 - protein, 32 aa, Plasmodium falciparum
YGVAHISFYLFLHNLLNHLFALKLLTQQEINI

SEQ ID NO: 3395942 - protein, 25 aa, Plasmodium falciparum
YGVKLNYVYYPYNKCQKIIPFDNNN

SEQ ID NO: 3395943 - protein, 27 aa, Plasmodium falciparum
YGYNKYKNYYNYYKLYNYNKMTNDEYE

SEQ ID NO: 3395944 - protein, 27 aa, Plasmodium falciparum
YHDAFLKQSIIFPLNKDISLGSGKLCA

SEQ ID NO: 3395945 - protein, 25 aa, Plasmodium falciparum
YHDNIYVLLKGKKTFRIYSPNFAYR

SEQ ID NO: 3395946 - protein, 26 aa, Plasmodium falciparum
YHDSIKYTYIIPSKYTVSTIIIYDNE

SEQ ID NO: 3395947 - protein, 34 aa, Plasmodium falciparum
YHEHIFISIYVNCTNIYIWDVLEGTPINIIHTIQ

SEQ ID NO: 3395948 - protein, 26 aa, Plasmodium falciparum
YHGPGQLVLYFIFNLKNYPSNYNERI

SEQ ID NO: 3395949 - protein, 18 aa, Plasmodium falciparum
YHIFMEKTNVHISDIIHN

SEQ ID NO: 3395950 - protein, 33 aa, Plasmodium falciparum
YHINIYEKYIIYILSKYFWPGPLSIIAKAKKEA

SEQ ID NO: 3395951 - protein, 20 aa, Plasmodium falciparum
YHINNYNNNIYFYEPCEKDN

SEQ ID NO: 3395952 - protein, 28 aa, Plasmodium falciparum
YHKEMEGYIMDTIMGIILNELKGKNNVK

SEQ ID NO: 3395953 - protein, 18 aa, Plasmodium falciparum
YHKFKSDLGLIYARKKKV

SEQ ID NO: 3395954 - protein, 26 aa, Plasmodium falciparum
YHKIFFLNDMYNCNLFFKKIGERNHN

SEQ ID NO: 3395955 - protein, 30 aa, Plasmodium falciparum
YHKNESEKSIFVPLLSKLSDKNYPNIYENS

SEQ ID NO: 3395956 - protein, 29 aa, Plasmodium falciparum
YHKSNNNYLFIFPRLFSYSQYYREKKILR

SEQ ID NO: 3395957 - protein, 32 aa, Plasmodium falciparum
YHKYNFISMHLKNLIYIYITENFHNLNEFFNA

SEQ ID NO: 3395958 - protein, 23 aa, Plasmodium falciparum
YHLEKYFFSNIIPQQTKINLTKM

SEQ ID NO: 3395959 - protein, 17 aa, Plasmodium falciparum
YHLLYHGYIKAHEYNNS

SEQ ID NO: 3395960 - protein, 17 aa, Plasmodium falciparum
YHMNLCALIKKIKNYIN

SEQ ID NO: 3395961 - protein, 20 aa, Plasmodium falciparum
YHNIAKYLPLKDLKIYLCEV

SEQ ID NO: 3395962 - protein, 20 aa, Plasmodium falciparum
YHNLNLCPSTIFRKKNNNKK

SEQ ID NO: 3395963 - protein, 28 aa, Plasmodium falciparum
YHPYNKNMLLILQDKLVQISKLLKRIMN

SEQ ID NO: 3395964 - protein, 17 aa, Plasmodium falciparum
YHQYIDEGWLYYVNDEK

SEQ ID NO: 3395965 - protein, 27 aa, Plasmodium falciparum
YHRDNDILDILPLSFIINIKNYEWKKR

SEQ ID NO: 3395966 - protein, 30 aa, Plasmodium falciparum
YHRIPAPWIQIKILSIFRILGYSNKKLSEQ

SEQ ID NO: 3395967 - protein, 19 aa, Plasmodium falciparum
YHSFKYYNYFKSFTFDHLV

SEQ ID NO: 3395968 - protein, 17 aa, Plasmodium falciparum
YHSMDNVTYKKIFINNY

SEQ ID NO: 3395969 - protein, 25 aa, Plasmodium falciparum
YIAHSFNSILLQLSNYIFNIECKQM

SEQ ID NO: 3395970 - protein, 28 aa, Plasmodium falciparum
YIAPSFSFLIFLTRHFLKVINKKSSIFI

SEQ ID NO: 3395971 - protein, 26 aa, Plasmodium falciparum
YIARDGKVYFYLSSKFASLALQKKKA

SEQ ID NO: 3395972 - protein, 25 aa, Plasmodium falciparum
YIDDEQFHFFLRNLGFSYMTIQIGN

SEQ ID NO: 3395973 - protein, 17 aa, Plasmodium falciparum
YIDIYKYCKERNILFIN

SEQ ID NO: 3395974 - protein, 24 aa, Plasmodium falciparum
YIDKKYMINVKRILMYIKEYEEDF

SEQ ID NO: 3395975 - protein, 22 aa, Plasmodium falciparum
YIDKYLYICGYVYEYDRIFLLD

SEQ ID NO: 3395976 - protein, 25 aa, Plasmodium falciparum
YIDNKTPVLFLLTTGYDPSKEIEDY

SEQ ID NO: 3395977 - protein, 25 aa, Plasmodium falciparum
YIDNPQKAFLFDENDLKELFSYYKG

SEQ ID NO: 3395978 - protein, 22 aa, Plasmodium falciparum
YIDYFRRHFIENILLSCVEKKK

SEQ ID NO: 3395979 - protein, 25 aa, Plasmodium falciparum
YIEENLLIPKLYGRTYEKLNSCNIK

SEQ ID NO: 3395980 - protein, 17 aa, Plasmodium falciparum
YIEFMKMKKTYNGVLYF

SEQ ID NO: 3395981 - protein, 19 aa, Plasmodium falciparum
YIEGYEPWWLKCVIKKMKI

SEQ ID NO: 3395982 - protein, 19 aa, Plasmodium falciparum
YIEIFEKILKLFTHICENV

SEQ ID NO: 3395983 - protein, 18 aa, Plasmodium falciparum
YIEILSVIQNMGPILDMC

SEQ ID NO: 3395984 - protein, 18 aa, Plasmodium falciparum
YIENCLPKILLYLSNIND

SEQ ID NO: 3395985 - protein, 29 aa, Plasmodium falciparum
YIENDEKKFWFLHFSDIMKDIINNFIENE

SEQ ID NO: 3395986 - protein, 17 aa, Plasmodium falciparum
YIENIVSKILYMNKKRS

SEQ ID NO: 3395987 - protein, 26 aa, Plasmodium falciparum
YIETKNILKFFINFNFKRYSLNFIND

SEQ ID NO: 3395988 - protein, 32 aa, Plasmodium falciparum
YIEYKHFFQVLERLSAFLFRKLIMTEQEKFNV

SEQ ID NO: 3395989 - protein, 25 aa, Plasmodium falciparum
YIFIFILLTNKFLKTFDYVESKHWN

SEQ ID NO: 3395990 - protein, 18 aa, Plasmodium falciparum
YIFTIILCASNLFNNNVV

SEQ ID NO: 3395991 - protein, 19 aa, Plasmodium falciparum
YIFYHILNTPFYASLYIGT

SEQ ID NO: 3395992 - protein, 17 aa, Plasmodium falciparum
YIGKIITVCGWSKAIRK

SEQ ID NO: 3395993 - protein, 19 aa, Plasmodium falciparum
YIGKIYILPNSKRNNKYKY

SEQ ID NO: 3395994 - protein, 35 aa, Plasmodium falciparum
YIGVEWKLQLEIIKYKMIEIINKKLQKYTNKDIKL

SEQ ID NO: 3395995 - protein, 17 aa, Plasmodium falciparum
YIHFSCHNSLFNTLFFF

SEQ ID NO: 3395996 - protein, 19 aa, Plasmodium falciparum
YIHHIFNNENISFFSLYNL

SEQ ID NO: 3395997 - protein, 18 aa, Plasmodium falciparum
YIHKCKVKYGLKILKNFY

SEQ ID NO: 3395998 - protein, 18 aa, Plasmodium falciparum
YIINIMKYVYVINNDYIL

SEQ ID NO: 3395999 - protein, 20 aa, Plasmodium falciparum
YIINVLFTQYFIKCEGNKVT

SEQ ID NO: 3396000 - protein, 25 aa, Plasmodium falciparum
YIISKNNFNWVLWDELITTNHNFLP

SEQ ID NO: 3396001 - protein, 18 aa, Plasmodium falciparum
YIKCFKDGKYKILSFGFV

SEQ ID NO: 3396002 - protein, 19 aa, Plasmodium falciparum
YIKCLKIFEPDIFCIPCEE

SEQ ID NO: 3396003 - protein, 17 aa, Plasmodium falciparum
YIKCLKIILHISKDIPS

SEQ ID NO: 3396004 - protein, 27 aa, Plasmodium falciparum
YIKFVNHYFNIIYSNNINILFKYECIL

SEQ ID NO: 3396005 - protein, 25 aa, Plasmodium falciparum
YIKGYPLSHVKLNNPYKIIDTLFNI

SEQ ID NO: 3396006 - protein, 17 aa, Plasmodium falciparum
YIKKERRKNSENGFVNL

SEQ ID NO: 3396007 - protein, 18 aa, Plasmodium falciparum
YIKKKKMNIIYEKTIYDD

SEQ ID NO: 3396008 - protein, 17 aa, Plasmodium falciparum
YIKKLKTCRFDADDIRN

SEQ ID NO: 3396009 - protein, 27 aa, Plasmodium falciparum
YIKNNFDFLVRSIIFPLLCYNNEDIEK

SEQ ID NO: 3396010 - protein, 18 aa, Plasmodium falciparum
YIKNPWGCIRWKGRYSHN

SEQ ID NO: 3396011 - protein, 20 aa, Plasmodium falciparum
YIKQIKLPKYADDESIIFIN

SEQ ID NO: 3396012 - protein, 19 aa, Plasmodium falciparum
YIKSFDLIQYNHYVTPCNI

SEQ ID NO: 3396013 - protein, 19 aa, Plasmodium falciparum
YIKVEDNMNFFIERPKNDN

SEQ ID NO: 3396014 - protein, 20 aa, Plasmodium falciparum
YIKVLCKIIYLSFSAHADSN

SEQ ID NO: 3396015 - protein, 18 aa, Plasmodium falciparum
YIKYIMDYYDIVSLQWGD

SEQ ID NO: 3396016 - protein, 18 aa, Plasmodium falciparum
YIKYNPHILLIRQNIKKY

SEQ ID NO: 3396017 - protein, 24 aa, Plasmodium falciparum
YIKYNYNKIPFLICTKKFIEQNKG

SEQ ID NO: 3396018 - protein, 21 aa, Plasmodium falciparum
YILDNIKCFCLFATHFHEMSN

SEQ ID NO: 3396019 - protein, 19 aa, Plasmodium falciparum
YILFNRQPSLHKMSIMGHK

SEQ ID NO: 3396020 - protein, 26 aa, Plasmodium falciparum
YILKKSNLNFLSIRIHIDEKKIGCRK

SEQ ID NO: 3396021 - protein, 27 aa, Plasmodium falciparum
YILKKYMKMLKYKFITFTYGPYILHIC

SEQ ID NO: 3396022 - protein, 24 aa, Plasmodium falciparum
YILNPNHYILFNVNVLLAGLLRYD

SEQ ID NO: 3396023 - protein, 29 aa, Plasmodium falciparum
YILNQINNIYIYRLIINYLYKIEDKLNIY

SEQ ID NO: 3396024 - protein, 33 aa, Plasmodium falciparum
YILNSFSFNLMNCYFLKFISNYLKYVNMPNGSN

SEQ ID NO: 3396025 - protein, 21 aa, Plasmodium falciparum
YILNTIKCFCLFATHFHEMSN

SEQ ID NO: 3396026 - protein, 19 aa, Plasmodium falciparum
YILSVSFDYNYLKIVPHVI

SEQ ID NO: 3396027 - protein, 18 aa, Plasmodium falciparum
YIMELLIHKYHTFDNTDH

SEQ ID NO: 3396028 - protein, 18 aa, Plasmodium falciparum
YIMHICPIYLYEVKNNNG

SEQ ID NO: 3396029 - protein, 19 aa, Plasmodium falciparum
YIMNDLEKCKTCMEGEKEI

SEQ ID NO: 3396030 - protein, 25 aa, Plasmodium falciparum
YINDQKNYLNLFYKGKKENNMITPM

SEQ ID NO: 3396031 - protein, 18 aa, Plasmodium falciparum
YINEAKYYALFKNIFKNS

SEQ ID NO: 3396032 - protein, 26 aa, Plasmodium falciparum
YINENPLKKNLQNKAFFATSGEKKIQ

SEQ ID NO: 3396033 - protein, 18 aa, Plasmodium falciparum
YINFLSYVSQENFEYFAS

SEQ ID NO: 3396034 - protein, 27 aa, Plasmodium falciparum
YINKEPLIPMVPWYKDFKGRIESNGKT

SEQ ID NO: 3396035 - protein, 17 aa, Plasmodium falciparum
YINKVFLDWINGDSINN

SEQ ID NO: 3396036 - protein, 30 aa, Plasmodium falciparum
YINKVKEIYYFHVFYHYIKLGFPEKEAAIE

SEQ ID NO: 3396037 - protein, 20 aa, Plasmodium falciparum
YINNIIQNSFMQYVKKFQGN

SEQ ID NO: 3396038 - protein, 34 aa, Plasmodium falciparum
YINNNFFNKLYTISFIHIPKIKDFYILQDNQFHL

SEQ ID NO: 3396039 - protein, 17 aa, Plasmodium falciparum
YINPKQLEFILNKLKQT

SEQ ID NO: 3396040 - protein, 18 aa, Plasmodium falciparum
YINSLMYKYIKLCDFNTS

SEQ ID NO: 3396041 - protein, 20 aa, Plasmodium falciparum
YINYEMFKFIFLNIDMNIEQ

SEQ ID NO: 3396042 - protein, 17 aa, Plasmodium falciparum
YIPFPNMDGKNNRIHIK

SEQ ID NO: 3396043 - protein, 17 aa, Plasmodium falciparum
YIPIYNYEDLIKSNINM

SEQ ID NO: 3396044 - protein, 20 aa, Plasmodium falciparum
YIPNKYIIGLSKFSRIVDVF

SEQ ID NO: 3396045 - protein, 26 aa, Plasmodium falciparum
YIPSLTSTIFDLLYVNSNKIEKNIYP

SEQ ID NO: 3396046 - protein, 17 aa, Plasmodium falciparum
YIPTFKNVSYLIELPNL

SEQ ID NO: 3396047 - protein, 23 aa, Plasmodium falciparum
YIPTSFIVLFKNQLGKLYLQKLE

SEQ ID NO: 3396048 - protein, 31 aa, Plasmodium falciparum
YIQDKYYLDINKLFESFLFKVISELDQGEAK

SEQ ID NO: 3396049 - protein, 36 aa, Plasmodium falciparum
YIQIDLSFFYFHDNLKLEGWFPLYDSLAGLKGELYC

SEQ ID NO: 3396050 - protein, 17 aa, Plasmodium falciparum
YIQLFEIMKILIHNNFP

SEQ ID NO: 3396051 - protein, 18 aa, Plasmodium falciparum
YIQNIYTQILPGPSMNHI

SEQ ID NO: 3396052 - protein, 17 aa, Plasmodium falciparum
YIQRDVIPLALEGKSIL

SEQ ID NO: 3396053 - protein, 17 aa, Plasmodium falciparum
YIRIIPLCRMNDASIKF

SEQ ID NO: 3396054 - protein, 19 aa, Plasmodium falciparum
YIRRFTWDDAKYPRSRSLT

SEQ ID NO: 3396055 - protein, 23 aa, Plasmodium falciparum
YISFYDVIHMFSFSLYYTETILN

SEQ ID NO: 3396056 - protein, 17 aa, Plasmodium falciparum
YISNIFLRKKNIYEIKK

SEQ ID NO: 3396057 - protein, 18 aa, Plasmodium falciparum
YISNLGMFNTYQFDAILP

SEQ ID NO: 3396058 - protein, 17 aa, Plasmodium falciparum
YISRPFFQDLRKKLDGV

SEQ ID NO: 3396059 - protein, 20 aa, Plasmodium falciparum
YISSFVFYSDNLLICGSFKG

SEQ ID NO: 3396060 - protein, 30 aa, Plasmodium falciparum
YISTYKNFEFLYFFCFNCNTYYDINIIMSQ

SEQ ID NO: 3396061 - protein, 19 aa, Plasmodium falciparum
YISYILKDEYPKTNIFNIC

SEQ ID NO: 3396062 - protein, 18 aa, Plasmodium falciparum
YITIFCYTTRKWREVVLL

SEQ ID NO: 3396063 - protein, 25 aa, Plasmodium falciparum
YITIPTFVHYLAKRKEYFLAYRICE

SEQ ID NO: 3396064 - protein, 19 aa, Plasmodium falciparum
YITLFYRLDVFNSADIKEL

SEQ ID NO: 3396065 - protein, 18 aa, Plasmodium falciparum
YITNRFLIYISETTKKEK

SEQ ID NO: 3396066 - protein, 21 aa, Plasmodium falciparum
YITPKYMIYIFNKVVCIINGI

SEQ ID NO: 3396067 - protein, 17 aa, Plasmodium falciparum
YITSCIAIPNICNFLVY

SEQ ID NO: 3396068 - protein, 25 aa, Plasmodium falciparum
YITTPCMHFLIYFLNYINENDEKID

SEQ ID NO: 3396069 - protein, 19 aa, Plasmodium falciparum
YIVCYNYLGKIQVKVFPAD

SEQ ID NO: 3396070 - protein, 21 aa, Plasmodium falciparum
YIVQTKIYMLLKNSTKMKASL

SEQ ID NO: 3396071 - protein, 31 aa, Plasmodium falciparum
YIWMRSLLCYTSERVEFFLLHEYNKKKFITP

SEQ ID NO: 3396072 - protein, 25 aa, Plasmodium falciparum
YIYADIPLKHMFNYINEIRAITQGQ

SEQ ID NO: 3396073 - protein, 42 aa, Plasmodium falciparum
YIYGEKNINTFLKWKRFRGMLKRYFFLLKNTNNNNYDNKKNK

SEQ ID NO: 3396074 - protein, 19 aa, Plasmodium falciparum
YIYIINELMKYNTQPALDY

SEQ ID NO: 3396075 - protein, 17 aa, Plasmodium falciparum
YIYIKELGNTKIYMNNL

SEQ ID NO: 3396076 - protein, 20 aa, Plasmodium falciparum
YIYIYIYVKSKITSAHTNLF

SEQ ID NO: 3396077 - protein, 17 aa, Plasmodium falciparum
YIYIYRISKNKYEFVKK

SEQ ID NO: 3396078 - protein, 17 aa, Plasmodium falciparum
YIYKNKLNKLNNKVINK

SEQ ID NO: 3396079 - protein, 19 aa, Plasmodium falciparum
YIYLDDESILLLDQLTFYE

SEQ ID NO: 3396080 - protein, 27 aa, Plasmodium falciparum
YIYNFINYCLLTYYDCKHYIIITYNQN

SEQ ID NO: 3396081 - protein, 19 aa, Plasmodium falciparum
YKCDICFKSYKRSDHLRNH

SEQ ID NO: 3396082 - protein, 19 aa, Plasmodium falciparum
YKCIYTIPIFINNTSQMNT

SEQ ID NO: 3396083 - protein, 29 aa, Plasmodium falciparum
YKCMHFYNNLRFKILQALFNKSKQSTQND

SEQ ID NO: 3396084 - protein, 22 aa, Plasmodium falciparum
YKCNFINADLSPFLNVNKAWEE

SEQ ID NO: 3396085 - protein, 25 aa, Plasmodium falciparum
YKDENFIYSLCYIYGDIESVNFMKG

SEQ ID NO: 3396086 - protein, 27 aa, Plasmodium falciparum
YKDGSTACIVLIYGPDDDGSLKVLCAN

SEQ ID NO: 3396087 - protein, 19 aa, Plasmodium falciparum
YKDKYNYCFKKYYELYLLN

SEQ ID NO: 3396088 - protein, 25 aa, Plasmodium falciparum
YKDSTLIMQLLRDNLTLWTSDLQGD

SEQ ID NO: 3396089 - protein, 21 aa, Plasmodium falciparum
YKDVLASYPCYYGLRIKDEPK

SEQ ID NO: 3396090 - protein, 20 aa, Plasmodium falciparum
YKECLLIPKIHFIRSCMHPS

SEQ ID NO: 3396091 - protein, 29 aa, Plasmodium falciparum
YKELNYFNYIYIYKRLLPYLANKIQKNKI

SEQ ID NO: 3396092 - protein, 31 aa, Plasmodium falciparum
YKEMHRSPVMPLRIEAFHSLEDQRLIYGKPD

SEQ ID NO: 3396093 - protein, 23 aa, Plasmodium falciparum
YKENDLLYYTNFDKTNIKNEEHI

SEQ ID NO: 3396094 - protein, 25 aa, Plasmodium falciparum
YKENKQYYDLLNTFTGNIMERKNIM

SEQ ID NO: 3396095 - protein, 19 aa, Plasmodium falciparum
YKENPIDSLPTLNVLKKYQ

SEQ ID NO: 3396096 - protein, 26 aa, Plasmodium falciparum
YKENVDIHWQLKWMNGVDNNVYGPYN

SEQ ID NO: 3396097 - protein, 25 aa, Plasmodium falciparum
YKESKYKLINVLQSAIYGSVYLSEV

SEQ ID NO: 3396098 - protein, 18 aa, Plasmodium falciparum
YKETSMINIWNKSSSKKN

SEQ ID NO: 3396099 - protein, 24 aa, Plasmodium falciparum
YKEWNKYLLSKKKDIAKLIEIDLK

SEQ ID NO: 3396100 - protein, 17 aa, Plasmodium falciparum
YKFFEKDINKFPIYCDM

SEQ ID NO: 3396101 - protein, 30 aa, Plasmodium falciparum
YKFKPRVMKIIFTKWLLFEKSQGNMHSQKT

SEQ ID NO: 3396102 - protein, 24 aa, Plasmodium falciparum
YKFSCEYIILSINILINKYIECNT

SEQ ID NO: 3396103 - protein, 21 aa, Plasmodium falciparum
YKGGLRFHPSVNLSIVKFLGF

SEQ ID NO: 3396104 - protein, 28 aa, Plasmodium falciparum
YKGIPRNLIICHLPFGPTLFCTIKDCKM

SEQ ID NO: 3396105 - protein, 26 aa, Plasmodium falciparum
YKHFKINEMYLYHIQSLYNDSVPTIP

SEQ ID NO: 3396106 - protein, 18 aa, Plasmodium falciparum
YKHIPIIAALKKINFVLL

SEQ ID NO: 3396107 - protein, 21 aa, Plasmodium falciparum
YKHLARDIILDTFKGINGCIL

SEQ ID NO: 3396108 - protein, 24 aa, Plasmodium falciparum
YKHRNSSFCFFKGSVKRFVSKNEV

SEQ ID NO: 3396109 - protein, 20 aa, Plasmodium falciparum
YKICDLGNSLWIDESRYAEI

SEQ ID NO: 3396110 - protein, 24 aa, Plasmodium falciparum
YKICDPSKVYPYYYVTKNEEATYN

SEQ ID NO: 3396111 - protein, 26 aa, Plasmodium falciparum
YKIFKPLIFLIYYNNNSPLYILNVFV

SEQ ID NO: 3396112 - protein, 29 aa, Plasmodium falciparum
YKIFKSWENFIYFFDNLFLIVKKDDDIFI

SEQ ID NO: 3396113 - protein, 25 aa, Plasmodium falciparum
YKIIEKFCLGRRKIELFGTNRNIRN

SEQ ID NO: 3396114 - protein, 20 aa, Plasmodium falciparum
YKIILYRQKIQFGNRSFEVQ

SEQ ID NO: 3396115 - protein, 27 aa, Plasmodium falciparum
YKIMEKYIIFMRDKKGHFFGDILVRFI

SEQ ID NO: 3396116 - protein, 25 aa, Plasmodium falciparum
YKINLLNHFCAKTEKLKIKYISMVH

SEQ ID NO: 3396117 - protein, 25 aa, Plasmodium falciparum
YKKAKMLAIECKNSVFYNEQNEENN

SEQ ID NO: 3396118 - protein, 17 aa, Plasmodium falciparum
YKKCVFLAYSSPTHYDC

SEQ ID NO: 3396119 - protein, 23 aa, Plasmodium falciparum
YKKIKFNFSINRKIYDEKKKIHG

SEQ ID NO: 3396120 - protein, 47 aa, Plasmodium falciparum
YKKKIYRTKNPWKNYCFKILHKLKKKEIACWFLKPVNPELDGIPNYF

SEQ ID NO: 3396121 - protein, 24 aa, Plasmodium falciparum
YKKKKILIKIKIKTNMKKLCNLKK

SEQ ID NO: 3396122 - protein, 25 aa, Plasmodium falciparum
YKKKKNRFSLYKWLSINDKVEQYYM

SEQ ID NO: 3396123 - protein, 32 aa, Plasmodium falciparum
YKKKLIHVKREYIFKINKLKKLLHSEVDDNIN

SEQ ID NO: 3396124 - protein, 28 aa, Plasmodium falciparum
YKKKSNMYGLFIINERLKCIYNNIENKR

SEQ ID NO: 3396125 - protein, 24 aa, Plasmodium falciparum
YKKLFEKLNLDIEKERLISKLKKI

SEQ ID NO: 3396126 - protein, 18 aa, Plasmodium falciparum
YKKLLVRNLIRNENKYIQ

SEQ ID NO: 3396127 - protein, 17 aa, Plasmodium falciparum
YKKMFGKIFRPPEIYMK

SEQ ID NO: 3396128 - protein, 23 aa, Plasmodium falciparum
YKKQNVFFLKAFFKNVINIKKER

SEQ ID NO: 3396129 - protein, 25 aa, Plasmodium falciparum
YKKTNYFCVRYFSILQRYIKARPHS

SEQ ID NO: 3396130 - protein, 28 aa, Plasmodium falciparum
YKKVYERYFNLFNFNFSNVELSFDLLIR

SEQ ID NO: 3396131 - protein, 19 aa, Plasmodium falciparum
YKLLPLGYGILYNHSDIPN

SEQ ID NO: 3396132 - protein, 18 aa, Plasmodium falciparum
YKLQKKKIIILGRKTEKY

SEQ ID NO: 3396133 - protein, 37 aa, Plasmodium falciparum
YKLRKTFFHNPSIKSFEWYKFMDELILIYDNIEEEKD

SEQ ID NO: 3396134 - protein, 25 aa, Plasmodium falciparum
YKLSILKKAFKLRKLFEVYNEHGFN

SEQ ID NO: 3396135 - protein, 18 aa, Plasmodium falciparum
YKLSYNFKNRLLFAATNN

SEQ ID NO: 3396136 - protein, 17 aa, Plasmodium falciparum
YKLTFINDYIFNSKYYK

SEQ ID NO: 3396137 - protein, 19 aa, Plasmodium falciparum
YKMNNAIGYFIKYNEYSTE

SEQ ID NO: 3396138 - protein, 49 aa, Plasmodium falciparum
YKNDTFWQYAISNDNIFLNFYLNALYQKLCNYFLINNISFEQFLKEQSI

SEQ ID NO: 3396139 - protein, 36 aa, Plasmodium falciparum
YKNEPGIMMMILKDLFERIKMLQIMNEYKVKCSFIE

SEQ ID NO: 3396140 - protein, 24 aa, Plasmodium falciparum
YKNKILYELYVGNYIHNLYEKITY

SEQ ID NO: 3396141 - protein, 27 aa, Plasmodium falciparum
YKNKLHKKIWILLKRKSNEKEFEHYYN

SEQ ID NO: 3396142 - protein, 24 aa, Plasmodium falciparum
YKNKLKINIKFFSKYECVQNIIKT

SEQ ID NO: 3396143 - protein, 24 aa, Plasmodium falciparum
YKNKNIKIIYDDGGAKRIVVKKKR

SEQ ID NO: 3396144 - protein, 23 aa, Plasmodium falciparum
YKNKSIIKKSYNLFKPCCHNKKE

SEQ ID NO: 3396145 - protein, 23 aa, Plasmodium falciparum
YKNLSMDEFFLNPNNIEANIINN

SEQ ID NO: 3396146 - protein, 36 aa, Plasmodium falciparum
YKNNIPIFKKIIKFGAMWIFYIYKNIQNEKDAFFLN

SEQ ID NO: 3396147 - protein, 25 aa, Plasmodium falciparum
YKNNKLFEHYKIDILKKLSFCIVYN

SEQ ID NO: 3396148 - protein, 25 aa, Plasmodium falciparum
YKNNPILNFSYFPIKPYDIKSCKEN

SEQ ID NO: 3396149 - protein, 24 aa, Plasmodium falciparum
YKNTPISLNLPDKLKVVIYTDNYV

SEQ ID NO: 3396150 - protein, 22 aa, Plasmodium falciparum
YKNVYFLTKREFEALCKKLEEY

SEQ ID NO: 3396151 - protein, 23 aa, Plasmodium falciparum
YKQLIMHFNSPFNFSSANIVYDI

SEQ ID NO: 3396152 - protein, 20 aa, Plasmodium falciparum
YKQLVVKNNSLFSITHDFIN

SEQ ID NO: 3396153 - protein, 47 aa, Plasmodium falciparum
YKQNINPLIFGYNSLIEFLFYGCREVCKIYILNNNLLIVHLSYDIAK

SEQ ID NO: 3396154 - protein, 17 aa, Plasmodium falciparum
YKRKNEKNLFSSLILLI

SEQ ID NO: 3396155 - protein, 37 aa, Plasmodium falciparum
YKRLGEPNFPYWCLGKYLPFVLVLETLNFEKEIDIYK

SEQ ID NO: 3396156 - protein, 18 aa, Plasmodium falciparum
YKRLYYDNRIKDTCKYEY

SEQ ID NO: 3396157 - protein, 19 aa, Plasmodium falciparum
YKRNEEFYFFTKNKYTKMY

SEQ ID NO: 3396158 - protein, 23 aa, Plasmodium falciparum
YKSAIILPYFDDWIKSIKKNKSN

SEQ ID NO: 3396159 - protein, 51 aa, Plasmodium falciparum
YKSAKDVWFPGFADSHVFLLKGNIFGILRACQLLYHYVKSKMSSSKCCIYL

SEQ ID NO: 3396160 - protein, 30 aa, Plasmodium falciparum
YKSIKLFCNFFKENKFLFYLNLENNDLTNQ

SEQ ID NO: 3396161 - protein, 26 aa, Plasmodium falciparum
YKSNIDDIFFFKEQSSLYKLSQYCIE

SEQ ID NO: 3396162 - protein, 32 aa, Plasmodium falciparum
YKSQEVFFLIDKLILFFFNIRNKKYSSVFWNS

SEQ ID NO: 3396163 - protein, 18 aa, Plasmodium falciparum
YKTFIYAKWIAKKINCKF

SEQ ID NO: 3396164 - protein, 27 aa, Plasmodium falciparum
YKTIHVACKIFLYKPKDLAEESYCESY

SEQ ID NO: 3396165 - protein, 27 aa, Plasmodium falciparum
YKTYDKNGMIYCKRIKFYLKNEREHDY

SEQ ID NO: 3396166 - protein, 17 aa, Plasmodium falciparum
YKVVIVPIFYKTTDENA

SEQ ID NO: 3396167 - protein, 31 aa, Plasmodium falciparum
YKYADYNYSLACAILLLIDRLNYPDIELNEN

SEQ ID NO: 3396168 - protein, 27 aa, Plasmodium falciparum
YKYEGKKIIEIPIHKPYLVTHDTVVNK

SEQ ID NO: 3396169 - protein, 23 aa, Plasmodium falciparum
YKYHPLCHNIRRDAYKKYACCKV

SEQ ID NO: 3396170 - protein, 20 aa, Plasmodium falciparum
YKYLLKCIIKIQRAFKKYMK

SEQ ID NO: 3396171 - protein, 18 aa, Plasmodium falciparum
YKYNCDVFNLLSLMPSHI

SEQ ID NO: 3396172 - protein, 29 aa, Plasmodium falciparum
YKYTRLHTCKPHYVLFSRCIKYRDKKLMK

SEQ ID NO: 3396173 - protein, 21 aa, Plasmodium falciparum
YLADFINKDIFFIGEIMNIEG

SEQ ID NO: 3396174 - protein, 17 aa, Plasmodium falciparum
YLCEIVDNMFKDIVNKI

SEQ ID NO: 3396175 - protein, 18 aa, Plasmodium falciparum
YLCFVLTVEIHIWSKNLK

SEQ ID NO: 3396176 - protein, 19 aa, Plasmodium falciparum
YLCIDDIFKKKENIDGKKK

SEQ ID NO: 3396177 - protein, 22 aa, Plasmodium falciparum
YLDIKPLLDLTCGKIASMMKDK

SEQ ID NO: 3396178 - protein, 17 aa, Plasmodium falciparum
YLDKINLDVIYNKLHYD

SEQ ID NO: 3396179 - protein, 17 aa, Plasmodium falciparum
YLDKNYLDKNYFDIDDY

SEQ ID NO: 3396180 - protein, 22 aa, Plasmodium falciparum
YLDMNFLCKYVQLSSLFPNKSN

SEQ ID NO: 3396181 - protein, 53 aa, Plasmodium falciparum
YLDNTSELNIKCIWAHPFLNTKSTYYILCAFLPRVILEAFLNSKGILHNDIND

SEQ ID NO: 3396182 - protein, 17 aa, Plasmodium falciparum
YLEMVISYILAMRLEEE

SEQ ID NO: 3396183 - protein, 26 aa, Plasmodium falciparum
YLENLKKICSYLKSTNIYFIKCIKPN

SEQ ID NO: 3396184 - protein, 44 aa, Plasmodium falciparum
YLESNKYIYPKIILYNKPLIRRGAILLKKNQVIILFKGCIVSGN

SEQ ID NO: 3396185 - protein, 19 aa, Plasmodium falciparum
YLEYILNKEVYVKNHFFFE

SEQ ID NO: 3396186 - protein, 42 aa, Plasmodium falciparum
YLFLAQGSARIYFILQHLCNINFLYQYDLNFFFNIMKDMFNN

SEQ ID NO: 3396187 - protein, 24 aa, Plasmodium falciparum
YLFNNFVSFVLIIDEKIYHSVTPI

SEQ ID NO: 3396188 - protein, 19 aa, Plasmodium falciparum
YLGSVCVNGFYLSDLKEET

SEQ ID NO: 3396189 - protein, 35 aa, Plasmodium falciparum
YLHDPQFIINLINFLFYIFNYWTKRDFSLYFTHDE

SEQ ID NO: 3396190 - protein, 21 aa, Plasmodium falciparum
YLHNKYYNDMLYLIIIQFCDE

SEQ ID NO: 3396191 - protein, 17 aa, Plasmodium falciparum
YLIIDKLPQEYDNRVKA

SEQ ID NO: 3396192 - protein, 47 aa, Plasmodium falciparum
YLINIKSILILYNSIDLNIFNFLFKVYFLYPFTKYVCNYLRQIKHFS

SEQ ID NO: 3396193 - protein, 18 aa, Plasmodium falciparum
YLISKLEKEKRIISNKTK

SEQ ID NO: 3396194 - protein, 23 aa, Plasmodium falciparum
YLKDLKRVLVCSVLLNGHYGHKG

SEQ ID NO: 3396195 - protein, 25 aa, Plasmodium falciparum
YLKKEQSIISDLFLGLIEEKITCSQ

SEQ ID NO: 3396196 - protein, 17 aa, Plasmodium falciparum
YLKLVNKFVKLKLQGNQ

SEQ ID NO: 3396197 - protein, 32 aa, Plasmodium falciparum
YLKNVGKIFLHQLFSWILYGQLIDPYNEFFIQ

SEQ ID NO: 3396198 - protein, 21 aa, Plasmodium falciparum
YLKRKKLFYSTTQSPILLVDF

SEQ ID NO: 3396199 - protein, 22 aa, Plasmodium falciparum
YLKYDIDILYYIYIKKYIEYCN

SEQ ID NO: 3396200 - protein, 17 aa, Plasmodium falciparum
YLLDSMVLCLKYPTIYE

SEQ ID NO: 3396201 - protein, 18 aa, Plasmodium falciparum
YLLEIKPSEAYAANCVIY

SEQ ID NO: 3396202 - protein, 18 aa, Plasmodium falciparum
YLLGNPFIKIALNDDLYI

SEQ ID NO: 3396203 - protein, 18 aa, Plasmodium falciparum
YLLNDKKVVISFINGDLY

SEQ ID NO: 3396204 - protein, 18 aa, Plasmodium falciparum
YLLNLRGYDYQYSPLFYS

SEQ ID NO: 3396205 - protein, 17 aa, Plasmodium falciparum
YLLTTFQSSYHNIVDYC

SEQ ID NO: 3396206 - protein, 23 aa, Plasmodium falciparum
YLMFNKQYYFYNYLKGIEITKMF

SEQ ID NO: 3396207 - protein, 24 aa, Plasmodium falciparum
YLNAKKLKINLTGFIGNKKSDIFI

SEQ ID NO: 3396208 - protein, 22 aa, Plasmodium falciparum
YLNKLRVYDLNQLCRKFLLPQH

SEQ ID NO: 3396209 - protein, 22 aa, Plasmodium falciparum
YLNKRIFHNKSKIWKLSNKKVT

SEQ ID NO: 3396210 - protein, 36 aa, Plasmodium falciparum
YLNKTCFGIPKFVQYTLFYLLTNHYIELYKYEKDKN

SEQ ID NO: 3396211 - protein, 23 aa, Plasmodium falciparum
YLNNATILDILKRRVDNNEQVNI

SEQ ID NO: 3396212 - protein, 25 aa, Plasmodium falciparum
YLNNKKCLIKLRKLLKSHLINSQIV

SEQ ID NO: 3396213 - protein, 26 aa, Plasmodium falciparum
YLNQNDLLIFITKWNKLSNNYLEIYP

SEQ ID NO: 3396214 - protein, 20 aa, Plasmodium falciparum
YLNSFLHDIYRLDRTFKLRK

SEQ ID NO: 3396215 - protein, 24 aa, Plasmodium falciparum
YLNTSAIHFKIVKCKLFDIGEGIS

SEQ ID NO: 3396216 - protein, 21 aa, Plasmodium falciparum
YLQFQTLYQHPSGRRRLRVTT

SEQ ID NO: 3396217 - protein, 19 aa, Plasmodium falciparum
YLQILLKNIYWPTDVNKKN

SEQ ID NO: 3396218 - protein, 29 aa, Plasmodium falciparum
YLQNIHILNKILALFKLSYIIKNRFRLNV

SEQ ID NO: 3396219 - protein, 24 aa, Plasmodium falciparum
YLQQKKLFIIPHRKGLSIYNKKKE

SEQ ID NO: 3396220 - protein, 18 aa, Plasmodium falciparum
YLQSYNVSIIPFVKAKKL

SEQ ID NO: 3396221 - protein, 17 aa, Plasmodium falciparum
YLRVGDSIVFYLIKGGN

SEQ ID NO: 3396222 - protein, 23 aa, Plasmodium falciparum
YLSEEKKRELRRKRFGVVNTDDA

SEQ ID NO: 3396223 - protein, 19 aa, Plasmodium falciparum
YLSLFLLLADHIINKSYQI

SEQ ID NO: 3396224 - protein, 19 aa, Plasmodium falciparum
YLSLYEIFKHLDNDKDSYI

SEQ ID NO: 3396225 - protein, 19 aa, Plasmodium falciparum
YLSVFTPELLQKLSFHFEQ

SEQ ID NO: 3396226 - protein, 25 aa, Plasmodium falciparum
YLTKSYYFKRLFSNPSYYIKEVQYV

SEQ ID NO: 3396227 - protein, 19 aa, Plasmodium falciparum
YLTSIFDSGKRKESWDNLF

SEQ ID NO: 3396228 - protein, 43 aa, Plasmodium falciparum
YLVEEIEYSFLILNNILFQYKYLLKHFLHLSNTFFDYYQNIIV

SEQ ID NO: 3396229 - protein, 19 aa, Plasmodium falciparum
YLYDKVNFFLIQNKAKINK

SEQ ID NO: 3396230 - protein, 17 aa, Plasmodium falciparum
YLYELKNIELKYTYKAH

SEQ ID NO: 3396231 - protein, 18 aa, Plasmodium falciparum
YLYHILSEISKYSNSSYS

SEQ ID NO: 3396232 - protein, 21 aa, Plasmodium falciparum
YLYKQLLYTCYENELSFIYQT

SEQ ID NO: 3396233 - protein, 21 aa, Plasmodium falciparum
YLYKTHVWIESYEPLFNKKYT

SEQ ID NO: 3396234 - protein, 18 aa, Plasmodium falciparum
YMCEDFQVYLIDVGSKSG

SEQ ID NO: 3396235 - protein, 17 aa, Plasmodium falciparum
YMDKINDVKFLKVLTHT

SEQ ID NO: 3396236 - protein, 24 aa, Plasmodium falciparum
YMDNKIYNILLKNNKIIYMKYDDT

SEQ ID NO: 3396237 - protein, 21 aa, Plasmodium falciparum
YMENIYGCQYISWGVDNNPFK

SEQ ID NO: 3396238 - protein, 18 aa, Plasmodium falciparum
YMFPSFINNKVFVLRNVI

SEQ ID NO: 3396239 - protein, 18 aa, Plasmodium falciparum
YMKDSLLDSLEKLLIKNV

SEQ ID NO: 3396240 - protein, 17 aa, Plasmodium falciparum
YMKNVMHANDKLSNSNV

SEQ ID NO: 3396241 - protein, 28 aa, Plasmodium falciparum
YMLGVLFLRIWNSKPLWLIANIEEDLNF

SEQ ID NO: 3396242 - protein, 17 aa, Plasmodium falciparum
YMLLKNSTKMKASLTFA

SEQ ID NO: 3396243 - protein, 23 aa, Plasmodium falciparum
YMLRPFYFISYSQDRFVTCLQFC

SEQ ID NO: 3396244 - protein, 17 aa, Plasmodium falciparum
YMNFLRKNRIETKTKTC

SEQ ID NO: 3396245 - protein, 23 aa, Plasmodium falciparum
YMNKKIYVNAPLDSYHHIYNNKY

SEQ ID NO: 3396246 - protein, 17 aa, Plasmodium falciparum
YMNKKRSRIKIICMSGT

SEQ ID NO: 3396247 - protein, 19 aa, Plasmodium falciparum
YMNLYLPNFTKNECLLICS

SEQ ID NO: 3396248 - protein, 24 aa, Plasmodium falciparum
YMNNFCIKWLSLFFSTIINKCILM

SEQ ID NO: 3396249 - protein, 20 aa, Plasmodium falciparum
YMNNYYFESYKKDKSMNILK

SEQ ID NO: 3396250 - protein, 25 aa, Plasmodium falciparum
YMPNKLMMMGNFRNLIDINKNVTNN

SEQ ID NO: 3396251 - protein, 25 aa, Plasmodium falciparum
YMQLYNDRIFDLLNPYNESAPYLST

SEQ ID NO: 3396252 - protein, 24 aa, Plasmodium falciparum
YMQSDLYNYFIRKGKLGTLGQLQI

SEQ ID NO: 3396253 - protein, 23 aa, Plasmodium falciparum
YMSALLKCSLLKNTLVIKKEWRD

SEQ ID NO: 3396254 - protein, 24 aa, Plasmodium falciparum
YMSFNIWNKVFKYVELILDILIQN

SEQ ID NO: 3396255 - protein, 17 aa, Plasmodium falciparum
YMYIYDNTGMEINCIKD

SEQ ID NO: 3396256 - protein, 19 aa, Plasmodium falciparum
YMYNINNMNYMPNVNSKYE

SEQ ID NO: 3396257 - protein, 20 aa, Plasmodium falciparum
YNAKEYIDLLKEKKMQLETC

SEQ ID NO: 3396258 - protein, 18 aa, Plasmodium falciparum
YNCEEFFNMNIKSIPYSV

SEQ ID NO: 3396259 - protein, 18 aa, Plasmodium falciparum
YNCRMTFKRFTKKRFKNK

SEQ ID NO: 3396260 - protein, 23 aa, Plasmodium falciparum
YNDDLYYREIQPLNTGWTKEETD

SEQ ID NO: 3396261 - protein, 22 aa, Plasmodium falciparum
YNDFLDKFSLYLPCYNLKEEWN

SEQ ID NO: 3396262 - protein, 19 aa, Plasmodium falciparum
YNDITTITFFKQKIYSQIY

SEQ ID NO: 3396263 - protein, 17 aa, Plasmodium falciparum
YNDKFMSGFNNIKKMVG

SEQ ID NO: 3396264 - protein, 17 aa, Plasmodium falciparum
YNDLRSYEQEFLNNLKN

SEQ ID NO: 3396265 - protein, 20 aa, Plasmodium falciparum
YNDMEGMILMSELSKRRFRS

SEQ ID NO: 3396266 - protein, 28 aa, Plasmodium falciparum
YNDNFTYRPTLFNLLEVLANHNITTPDQ

SEQ ID NO: 3396267 - protein, 32 aa, Plasmodium falciparum
YNDRNIIEKTPYYKLINFEKKLATERKRVLNY

SEQ ID NO: 3396268 - protein, 25 aa, Plasmodium falciparum
YNDSYKLHKILPSKVDPLVSLMKVE

SEQ ID NO: 3396269 - protein, 19 aa, Plasmodium falciparum
YNDYIFHKNLINSYIKVHE

SEQ ID NO: 3396270 - protein, 17 aa, Plasmodium falciparum
YNDYLKNDNFSKYLSSK

SEQ ID NO: 3396271 - protein, 28 aa, Plasmodium falciparum
YNEDFFIKVLKIIKIFNQFKFFSKLKNI

SEQ ID NO: 3396272 - protein, 24 aa, Plasmodium falciparum
YNEDNLFYKFYTYGYTYKNQIIKS

SEQ ID NO: 3396273 - protein, 26 aa, Plasmodium falciparum
YNEEDIFYLFFIICCDRSYLKNFHAS

SEQ ID NO: 3396274 - protein, 26 aa, Plasmodium falciparum
YNEESIYRYLTLNPLQINKTVVILTI

SEQ ID NO: 3396275 - protein, 23 aa, Plasmodium falciparum
YNEHGFNYILRSMNKIQLIKKNK

SEQ ID NO: 3396276 - protein, 27 aa, Plasmodium falciparum
YNEIIDLIHIWNFLCKENNTYEMLNET

SEQ ID NO: 3396277 - protein, 26 aa, Plasmodium falciparum
YNEIQNIFIFLEMTTDYKPNLLQQSC

SEQ ID NO: 3396278 - protein, 25 aa, Plasmodium falciparum
YNELMEYYYFLGNIHEIHKSRFFIT

SEQ ID NO: 3396279 - protein, 17 aa, Plasmodium falciparum
YNELYVYNKKGISGGDK

SEQ ID NO: 3396280 - protein, 25 aa, Plasmodium falciparum
YNEMNSLKLIYNYINNLNINNKKTN

SEQ ID NO: 3396281 - protein, 25 aa, Plasmodium falciparum
YNEQKEFINFIYMNNQKVLIAKGGK

SEQ ID NO: 3396282 - protein, 20 aa, Plasmodium falciparum
YNEQLVNKLIHKRKKKGKGK

SEQ ID NO: 3396283 - protein, 22 aa, Plasmodium falciparum
YNEVLTCLFIQSVDILKAEDIS

SEQ ID NO: 3396284 - protein, 18 aa, Plasmodium falciparum
YNFHTNIPLHILVNRISL

SEQ ID NO: 3396285 - protein, 25 aa, Plasmodium falciparum
YNFKAEFIQVAKLYNRLAISYINMK

SEQ ID NO: 3396286 - protein, 19 aa, Plasmodium falciparum
YNFLDLHQNFINDILLDHF

SEQ ID NO: 3396287 - protein, 34 aa, Plasmodium falciparum
YNFNRYENFLINHLTYNFPKNDLFKLSYKVSMNN

SEQ ID NO: 3396288 - protein, 35 aa, Plasmodium falciparum
YNFQWDIKIILNMHAWIVTYYTNLYIYENRKRFYN

SEQ ID NO: 3396289 - protein, 23 aa, Plasmodium falciparum
YNFYVFNPITKCIMIIDKQKKVD

SEQ ID NO: 3396290 - protein, 30 aa, Plasmodium falciparum
YNGKKEVPLPFDTKALIFNQNKKELFESCT

SEQ ID NO: 3396291 - protein, 29 aa, Plasmodium falciparum
YNGLNINSFLRFPKFHKILLDVPCSTDEH

SEQ ID NO: 3396292 - protein, 27 aa, Plasmodium falciparum
YNGYIPTYYFTIPKLLLQWDTSKYKRC

SEQ ID NO: 3396293 - protein, 25 aa, Plasmodium falciparum
YNHKKKILYIILQNGNNKSEEKKIH

SEQ ID NO: 3396294 - protein, 17 aa, Plasmodium falciparum
YNHKRNILKKSASANMM

SEQ ID NO: 3396295 - protein, 34 aa, Plasmodium falciparum
YNHKVDAWSIGIILYLLLSGKLPFPINKNTEMNI

SEQ ID NO: 3396296 - protein, 21 aa, Plasmodium falciparum
YNHSECNIIYPVINKSLDMDV

SEQ ID NO: 3396297 - protein, 35 aa, Plasmodium falciparum
YNIEAYLMECLKVLIPLNMRDIFLGSENIILDSMN

SEQ ID NO: 3396298 - protein, 42 aa, Plasmodium falciparum
YNIHEYDNLLEIIKSIRVVQRNLVFVIGITATYAKKTVLKKN

SEQ ID NO: 3396299 - protein, 17 aa, Plasmodium falciparum
YNIKIKYIKKFNGLHQE

SEQ ID NO: 3396300 - protein, 24 aa, Plasmodium falciparum
YNIKKLLNILSIEYIFASINIFLS

SEQ ID NO: 3396301 - protein, 17 aa, Plasmodium falciparum
YNILEDDYILFLNDCEL

SEQ ID NO: 3396302 - protein, 24 aa, Plasmodium falciparum
YNIMKTFLISYNYDIILIKTSHMN

SEQ ID NO: 3396303 - protein, 30 aa, Plasmodium falciparum
YNIMSDINSWIDTLYILFEAIHSNTSLKTL

SEQ ID NO: 3396304 - protein, 34 aa, Plasmodium falciparum
YNINKKNIILYKKQKKYNIFYNKYIKSINRDHFK

SEQ ID NO: 3396305 - protein, 26 aa, Plasmodium falciparum
YNINNYIYDVYISKLIFVMVNIYNEH

SEQ ID NO: 3396306 - protein, 22 aa, Plasmodium falciparum
YNIYDQFMFFQKDNLPLYTQRQ

SEQ ID NO: 3396307 - protein, 18 aa, Plasmodium falciparum
YNKFKNDGSFLQQVLAMQ

SEQ ID NO: 3396308 - protein, 20 aa, Plasmodium falciparum
YNKGFLFPRVEKYETPFGFL

SEQ ID NO: 3396309 - protein, 24 aa, Plasmodium falciparum
YNKIKLMEILDFFNSFNIDNQLQK

SEQ ID NO: 3396310 - protein, 30 aa, Plasmodium falciparum
YNKKRIYAENYGLIKIIRNAENLPINFELN

SEQ ID NO: 3396311 - protein, 26 aa, Plasmodium falciparum
YNKLETEFFILNKTKNVLMDKLEKFT

SEQ ID NO: 3396312 - protein, 20 aa, Plasmodium falciparum
YNKLMLYNDLDAHNNIDAPK

SEQ ID NO: 3396313 - protein, 20 aa, Plasmodium falciparum
YNKNDMFKKIPSQNYDTIKR

SEQ ID NO: 3396314 - protein, 25 aa, Plasmodium falciparum
YNKNIFIDNFIYNLFNYHKIAKGHT

SEQ ID NO: 3396315 - protein, 25 aa, Plasmodium falciparum
YNKNINLSIVFFLTNPREKIERSKK

SEQ ID NO: 3396316 - protein, 19 aa, Plasmodium falciparum
YNKPFIYKKLIVFDYDDTI

SEQ ID NO: 3396317 - protein, 18 aa, Plasmodium falciparum
YNKYYKCSFYVDKNINNI

SEQ ID NO: 3396318 - protein, 23 aa, Plasmodium falciparum
YNLDLIKCLQDDSGIYFILDPSK

SEQ ID NO: 3396319 - protein, 19 aa, Plasmodium falciparum
YNLGKILNVAYSFNIDCLY

SEQ ID NO: 3396320 - protein, 17 aa, Plasmodium falciparum
YNLLHESVLFTFEKDFT

SEQ ID NO: 3396321 - protein, 32 aa, Plasmodium falciparum
YNLLKDRYDVLYKKYIKLLTTYSCKNEDFTFI

SEQ ID NO: 3396322 - protein, 31 aa, Plasmodium falciparum
YNLNDLHSYIYKINLPLKPRYVNYILEEKKK

SEQ ID NO: 3396323 - protein, 25 aa, Plasmodium falciparum
YNLNNQFINAYPINNLNYNSTSHFN

SEQ ID NO: 3396324 - protein, 18 aa, Plasmodium falciparum
YNLTRNVSINHLKEIFMN

SEQ ID NO: 3396325 - protein, 17 aa, Plasmodium falciparum
YNMQLKSIKFNLSDKKN

SEQ ID NO: 3396326 - protein, 26 aa, Plasmodium falciparum
YNNFIPLYLCAFLKREINYIKQNKNI

SEQ ID NO: 3396327 - protein, 33 aa, Plasmodium falciparum
YNNIENQYTYHTLPFTTYPWENNYNMYNINDVQ

SEQ ID NO: 3396328 - protein, 17 aa, Plasmodium falciparum
YNNIFNYSYNLYDLLKI

SEQ ID NO: 3396329 - protein, 37 aa, Plasmodium falciparum
YNNILQYYDFFLILRKKKLYLWNLERTYTGLKLKENI

SEQ ID NO: 3396330 - protein, 19 aa, Plasmodium falciparum
YNNINKVIYKIYNNKKKNI

SEQ ID NO: 3396331 - protein, 26 aa, Plasmodium falciparum
YNNIVSWPMLIDYFNELYNINKKHLD

SEQ ID NO: 3396332 - protein, 32 aa, Plasmodium falciparum
YNNKDIYALLKSWRQYVTALKSTQRYLGFRIC

SEQ ID NO: 3396333 - protein, 36 aa, Plasmodium falciparum
YNNKVLKFFQIKQDIFIIIWICLKLGIDSLNVSKYK

SEQ ID NO: 3396334 - protein, 18 aa, Plasmodium falciparum
YNNLFINSKCEWIDILEI

SEQ ID NO: 3396335 - protein, 23 aa, Plasmodium falciparum
YNNLNYSFLPYGGISFILANLRA

SEQ ID NO: 3396336 - protein, 31 aa, Plasmodium falciparum
YNNLYDYNFIPSNIKFNFLNEINIIPTNLSV

SEQ ID NO: 3396337 - protein, 31 aa, Plasmodium falciparum
YNNMNVHHLGFNLFDLIKINDDVLLKNEYIN

SEQ ID NO: 3396338 - protein, 18 aa, Plasmodium falciparum
YNNMSSNYLLNLYNNSNN

SEQ ID NO: 3396339 - protein, 27 aa, Plasmodium falciparum
YNNNKYMDLVKFLLKKYPHLRFQDCYV

SEQ ID NO: 3396340 - protein, 26 aa, Plasmodium falciparum
YNNRFSEGYILKRDNKLARYNSDKRV

SEQ ID NO: 3396341 - protein, 32 aa, Plasmodium falciparum
YNNSEGDLKKYFILNNKYLIENANKYNNQYII

SEQ ID NO: 3396342 - protein, 26 aa, Plasmodium falciparum
YNNSENHFNLFGNYNFFGNNCIHCKS

SEQ ID NO: 3396343 - protein, 34 aa, Plasmodium falciparum
YNNSIDLYKKKIDMLNLKFLKLKNEYTHANNENI

SEQ ID NO: 3396344 - protein, 36 aa, Plasmodium falciparum
YNNTNSYIAPCLPYSYYYIPPFNETNIRNSNYPPTY

SEQ ID NO: 3396345 - protein, 18 aa, Plasmodium falciparum
YNNVIQVFCFKPPNFYLI

SEQ ID NO: 3396346 - protein, 25 aa, Plasmodium falciparum
YNNYRKLFIYKLKSLTFLDYKPIKT

SEQ ID NO: 3396347 - protein, 28 aa, Plasmodium falciparum
YNNYYKMNDMLGGIILPNNNQLNNMDNM

SEQ ID NO: 3396348 - protein, 31 aa, Plasmodium falciparum
YNQFVRCDTLLYLLVYPQKPLVKSKTIEFIN

SEQ ID NO: 3396349 - protein, 19 aa, Plasmodium falciparum
YNQKKSSSLFLYDIDNMKK

SEQ ID NO: 3396350 - protein, 20 aa, Plasmodium falciparum
YNQLIYFYEQNFGDIEKRFE

SEQ ID NO: 3396351 - protein, 21 aa, Plasmodium falciparum
YNRKNYGLLGILKVIKMTDPN

SEQ ID NO: 3396352 - protein, 25 aa, Plasmodium falciparum
YNRQIYPPINVLPSLSRLMKSGIGH

SEQ ID NO: 3396353 - protein, 17 aa, Plasmodium falciparum
YNSFDKEFLFNNKINVL

SEQ ID NO: 3396354 - protein, 17 aa, Plasmodium falciparum
YNSFVNNVYHFAISYEQ

SEQ ID NO: 3396355 - protein, 26 aa, Plasmodium falciparum
YNSFYKYLLLLFNKNIFKYYNIHIFH

SEQ ID NO: 3396356 - protein, 20 aa, Plasmodium falciparum
YNSILTLKRLILSTDSVVVI

SEQ ID NO: 3396357 - protein, 31 aa, Plasmodium falciparum
YNSKILTKMQLHILLYQLIVILSERQKIEWN

SEQ ID NO: 3396358 - protein, 23 aa, Plasmodium falciparum
YNSKYYCMNKKYSAYHDNIILCP

SEQ ID NO: 3396359 - protein, 24 aa, Plasmodium falciparum
YNSLYDNMILLKNKMENIKEQNKI

SEQ ID NO: 3396360 - protein, 24 aa, Plasmodium falciparum
YNSNYNYNYYYHNNINDYDDYYDI

SEQ ID NO: 3396361 - protein, 24 aa, Plasmodium falciparum
YNTHLNIKSILDDAIEINQNTIDY

SEQ ID NO: 3396362 - protein, 38 aa, Plasmodium falciparum
YNTILNELKTYKSLPIILGNILPYWTKDKNIKKIKKSI

SEQ ID NO: 3396363 - protein, 23 aa, Plasmodium falciparum
YNTKLIEFNLSNNLFKKLDEKNP

SEQ ID NO: 3396364 - protein, 18 aa, Plasmodium falciparum
YNTKYLLKKINGMIFQDT

SEQ ID NO: 3396365 - protein, 19 aa, Plasmodium falciparum
YNTSYYGLSPNINNNMDDW

SEQ ID NO: 3396366 - protein, 20 aa, Plasmodium falciparum
YNVFYNKYFIKNTFQNKNKL

SEQ ID NO: 3396367 - protein, 26 aa, Plasmodium falciparum
YNVKKKWERMLPISKRKKLSTQIRIN

SEQ ID NO: 3396368 - protein, 28 aa, Plasmodium falciparum
YNVYQYYVDVDFVHYYNAPVNKETQAQL

SEQ ID NO: 3396369 - protein, 21 aa, Plasmodium falciparum
YNYCFKKYYELYLLNKDSDNK

SEQ ID NO: 3396370 - protein, 24 aa, Plasmodium falciparum
YNYETWYAFLEILLKKLKVKAFCN

SEQ ID NO: 3396371 - protein, 19 aa, Plasmodium falciparum
YNYFKSFTFDHLVALFCLF

SEQ ID NO: 3396372 - protein, 19 aa, Plasmodium falciparum
YNYHNMNPGLNNFNSFNNA

SEQ ID NO: 3396373 - protein, 24 aa, Plasmodium falciparum
YNYKYGDFVILCRTNKTLKETLKS

SEQ ID NO: 3396374 - protein, 21 aa, Plasmodium falciparum
YNYKYLYMYERLGEKYKRLNT

SEQ ID NO: 3396375 - protein, 27 aa, Plasmodium falciparum
YNYLGSYGCNYPYNNNYYVDENEKCYD

SEQ ID NO: 3396376 - protein, 28 aa, Plasmodium falciparum
YNYLKIDINGYYILSYLLSFPKESITNL

SEQ ID NO: 3396377 - protein, 18 aa, Plasmodium falciparum
YNYMINNNKLNYMQNRNP

SEQ ID NO: 3396378 - protein, 29 aa, Plasmodium falciparum
YNYNPLNHGPYNPMYYYNYNNIKGNNQTT

SEQ ID NO: 3396379 - protein, 26 aa, Plasmodium falciparum
YNYNRLFCCHLVNLPLYKKRSHLKNE

SEQ ID NO: 3396380 - protein, 26 aa, Plasmodium falciparum
YPENKLPTILIYYNGTCIHQICNVLD

SEQ ID NO: 3396381 - protein, 23 aa, Plasmodium falciparum
YPLEKCILPFAEDYCFKYVCLLL

SEQ ID NO: 3396382 - protein, 25 aa, Plasmodium falciparum
YPLQNVLIRKVKILKRPKLDISKLM

SEQ ID NO: 3396383 - protein, 25 aa, Plasmodium falciparum
YPNISNFLSYLNLRNNVFFINYNEE

SEQ ID NO: 3396384 - protein, 22 aa, Plasmodium falciparum
YPNKIAPFHLNKSGYNEYKNEE

SEQ ID NO: 3396385 - protein, 19 aa, Plasmodium falciparum
YPNTYLLSSAIKYIDLIKK

SEQ ID NO: 3396386 - protein, 17 aa, Plasmodium falciparum
YPPPIPPLNHPSIPPTH

SEQ ID NO: 3396387 - protein, 19 aa, Plasmodium falciparum
YPSEVVQIISSIPLSYDNI

SEQ ID NO: 3396388 - protein, 17 aa, Plasmodium falciparum
YPSIYFTKHVYTAPEID

SEQ ID NO: 3396389 - protein, 36 aa, Plasmodium falciparum
YPSKKKLMPWFENFKLRIIFIKEWISKIRNNIFLPN

SEQ ID NO: 3396390 - protein, 18 aa, Plasmodium falciparum
YPSLPKFPNYNLNSQVQQ

SEQ ID NO: 3396391 - protein, 20 aa, Plasmodium falciparum
YPSTLNYYKFPKSCCTSVNE

SEQ ID NO: 3396392 - protein, 17 aa, Plasmodium falciparum
YPTYFTYKNFEKIIEET

SEQ ID NO: 3396393 - protein, 17 aa, Plasmodium falciparum
YPVFINHKNGKKKIWNL

SEQ ID NO: 3396394 - protein, 18 aa, Plasmodium falciparum
YPVSSWQVFEPNLSSKTL

SEQ ID NO: 3396395 - protein, 24 aa, Plasmodium falciparum
YPWNLLPNWKYWRKRKYNVKYEEI

SEQ ID NO: 3396396 - protein, 31 aa, Plasmodium falciparum
YPYDINYLQNKVCEVKILLDASLEKEKTLCE

SEQ ID NO: 3396397 - protein, 19 aa, Plasmodium falciparum
YPYEYKKIRKKLETYEILL

SEQ ID NO: 3396398 - protein, 18 aa, Plasmodium falciparum
YPYYYYYVYYYPSAARLV

SEQ ID NO: 3396399 - protein, 17 aa, Plasmodium falciparum
YQDFIENILFYIYRQEF

SEQ ID NO: 3396400 - protein, 31 aa, Plasmodium falciparum
YQDFKILFRNLLKCFSLFYALSYIEFDFIID

SEQ ID NO: 3396401 - protein, 23 aa, Plasmodium falciparum
YQEWNQCFTFKKKVLYAIEVLKN

SEQ ID NO: 3396402 - protein, 23 aa, Plasmodium falciparum
YQHIRKPILIPQNVDRYSNNKSE

SEQ ID NO: 3396403 - protein, 43 aa, Plasmodium falciparum
YQHNDNVIFLPCTHNFHKQCILKWISKNTTCPLCKIDLRNSYK

SEQ ID NO: 3396404 - protein, 18 aa, Plasmodium falciparum
YQIIKSNPFWWTNQRHDG

SEQ ID NO: 3396405 - protein, 32 aa, Plasmodium falciparum
YQISPLNNFNLYPLFNFVAYASLKINGVSITD

SEQ ID NO: 3396406 - protein, 17 aa, Plasmodium falciparum
YQKKELNIIKKDDKVNI

SEQ ID NO: 3396407 - protein, 22 aa, Plasmodium falciparum
YQKKLQNLFINKTVYENQDQRD

SEQ ID NO: 3396408 - protein, 19 aa, Plasmodium falciparum
YQKRLENLLKYFSKHNIKD

SEQ ID NO: 3396409 - protein, 17 aa, Plasmodium falciparum
YQKWLHHATKYLDKVWK

SEQ ID NO: 3396410 - protein, 18 aa, Plasmodium falciparum
YQLCRALSYIHSKFICHR

SEQ ID NO: 3396411 - protein, 29 aa, Plasmodium falciparum
YQMIKSHPFLNMFLLFETNGNISIWCFDK

SEQ ID NO: 3396412 - protein, 24 aa, Plasmodium falciparum
YQNIIIHKTAYYSFFLPIVCGMQM

SEQ ID NO: 3396413 - protein, 24 aa, Plasmodium falciparum
YQNPYKHAQIPVWIRLEYNCIHNP

SEQ ID NO: 3396414 - protein, 18 aa, Plasmodium falciparum
YQSQRFYEYFEVPLNSRK

SEQ ID NO: 3396415 - protein, 26 aa, Plasmodium falciparum
YQVFQKLRQWTDQNKLLMLREKMKQM

SEQ ID NO: 3396416 - protein, 21 aa, Plasmodium falciparum
YQVPSNFRFQEARKSFINPNV

SEQ ID NO: 3396417 - protein, 30 aa, Plasmodium falciparum
YQWERHHILILLYLFKLNRYIESFSSNKIK

SEQ ID NO: 3396418 - protein, 19 aa, Plasmodium falciparum
YRCHGIMNCTMCCPKGLDP

SEQ ID NO: 3396419 - protein, 48 aa, Plasmodium falciparum
YRDKKIIHEGWLNKWTNIIGSYRPRYFILENGLLRYSLDKYSPTKESF

SEQ ID NO: 3396420 - protein, 25 aa, Plasmodium falciparum
YRDSKLTHLLKNSLEGNCLVVMIAN

SEQ ID NO: 3396421 - protein, 22 aa, Plasmodium falciparum
YREYKIIYRRYASLYLIVGVSD

SEQ ID NO: 3396422 - protein, 19 aa, Plasmodium falciparum
YRFCIKKLCDKIIPNKCSF

SEQ ID NO: 3396423 - protein, 18 aa, Plasmodium falciparum
YRFIDLKGFMLKKFDRRF

SEQ ID NO: 3396424 - protein, 19 aa, Plasmodium falciparum
YRGKYHKYPLDIEASYRCK

SEQ ID NO: 3396425 - protein, 24 aa, Plasmodium falciparum
YRHEILRQWNKFLPEWVFNKKCEE

SEQ ID NO: 3396426 - protein, 27 aa, Plasmodium falciparum
YRHFCNKLWNAVKFFLKTLPDNYDNYN

SEQ ID NO: 3396427 - protein, 28 aa, Plasmodium falciparum
YRHRNVAKLLFINMLGYPTHFGQIECLK

SEQ ID NO: 3396428 - protein, 30 aa, Plasmodium falciparum
YRINYSGCLNFIPFFQDIDNFFKNKKYREQ

SEQ ID NO: 3396429 - protein, 18 aa, Plasmodium falciparum
YRISKYCFSIDFIKQYIS

SEQ ID NO: 3396430 - protein, 19 aa, Plasmodium falciparum
YRISPKLYKGRICKVVLRD

SEQ ID NO: 3396431 - protein, 23 aa, Plasmodium falciparum
YRKFYGFDDAYFLNKLQLKNKSP

SEQ ID NO: 3396432 - protein, 20 aa, Plasmodium falciparum
YRKNRTFALNTKRSKPVGTI

SEQ ID NO: 3396433 - protein, 18 aa, Plasmodium falciparum
YRKPRIGMYLFATQNYKQ

SEQ ID NO: 3396434 - protein, 19 aa, Plasmodium falciparum
YRKVLPTHKVARLKIANSK

SEQ ID NO: 3396435 - protein, 27 aa, Plasmodium falciparum
YRLSTHVKPLFWLDINITKKSLTKIEY

SEQ ID NO: 3396436 - protein, 24 aa, Plasmodium falciparum
YRLTQMFSATMPPSVERLSRKYLR

SEQ ID NO: 3396437 - protein, 19 aa, Plasmodium falciparum
YRMKKFSEPISMYDNYGFS

SEQ ID NO: 3396438 - protein, 23 aa, Plasmodium falciparum
YRNDLSFIEFLSRPSERLQWIGN

SEQ ID NO: 3396439 - protein, 19 aa, Plasmodium falciparum
YRNLHNQALLKHFSVTHSC

SEQ ID NO: 3396440 - protein, 24 aa, Plasmodium falciparum
YRNNYLGVLLNFNTLEEFLKCNKD

SEQ ID NO: 3396441 - protein, 26 aa, Plasmodium falciparum
YRNSAIMTIPIPQYKPILFQNGITVS

SEQ ID NO: 3396442 - protein, 17 aa, Plasmodium falciparum
YRNSYKHHPYDYKYNHE

SEQ ID NO: 3396443 - protein, 17 aa, Plasmodium falciparum
YRPPEILCNSTLYNYSV

SEQ ID NO: 3396444 - protein, 28 aa, Plasmodium falciparum
YRPTRRNILSALMWLTRDNKPGDILFFL

SEQ ID NO: 3396445 - protein, 24 aa, Plasmodium falciparum
YRQYSLKHLLLLLQFCVLHKCDKY

SEQ ID NO: 3396446 - protein, 22 aa, Plasmodium falciparum
YRRALLIVWAKLKSVVEVYKSL

SEQ ID NO: 3396447 - protein, 25 aa, Plasmodium falciparum
YRRKTYIYFPLIYAALDTTAYYSKL

SEQ ID NO: 3396448 - protein, 19 aa, Plasmodium falciparum
YRRLTVLNQIAWKALSNQI

SEQ ID NO: 3396449 - protein, 24 aa, Plasmodium falciparum
YRSMTIFHFLNIYNYMTFKQLRIF

SEQ ID NO: 3396450 - protein, 18 aa, Plasmodium falciparum
YRTHLRGTIFKRNYFWEK

SEQ ID NO: 3396451 - protein, 24 aa, Plasmodium falciparum
YRVDNLMSLLNYQNEYRIFGIRNC

SEQ ID NO: 3396452 - protein, 28 aa, Plasmodium falciparum
YRYCNLEYIYQFFKWGYVYDVNIMKDAN

SEQ ID NO: 3396453 - protein, 18 aa, Plasmodium falciparum
YSARIRRIIYDPQHLWKC

SEQ ID NO: 3396454 - protein, 25 aa, Plasmodium falciparum
YSDLDKLLLNIFNAEQKYFTEEIET

SEQ ID NO: 3396455 - protein, 26 aa, Plasmodium falciparum
YSDNDNFLSFYLKRKVSSFSDYNKES

SEQ ID NO: 3396456 - protein, 21 aa, Plasmodium falciparum
YSDVYLNYYLKNFNRYIKFSK

SEQ ID NO: 3396457 - protein, 18 aa, Plasmodium falciparum
YSDYFRKLNEISPNRIEN

SEQ ID NO: 3396458 - protein, 26 aa, Plasmodium falciparum
YSEEEKYFTRLIDFNYTDLKNYHIES

SEQ ID NO: 3396459 - protein, 26 aa, Plasmodium falciparum
YSEGNKKIFKYMNDLKYSSYNNLNDG

SEQ ID NO: 3396460 - protein, 30 aa, Plasmodium falciparum
YSEIFKYTDSHLKLFRQEQLILLAENERLT

SEQ ID NO: 3396461 - protein, 30 aa, Plasmodium falciparum
YSFDDCILQNDPLKYVNYISKLNTCIDTYN

SEQ ID NO: 3396462 - protein, 23 aa, Plasmodium falciparum
YSFDKWMVHIHKDDYWNIFNKDK

SEQ ID NO: 3396463 - protein, 28 aa, Plasmodium falciparum
YSFESKKFQYINDFTAKACLKCFAKQDI

SEQ ID NO: 3396464 - protein, 19 aa, Plasmodium falciparum
YSFFLPIVCGMQMGGISLD

SEQ ID NO: 3396465 - protein, 17 aa, Plasmodium falciparum
YSFGSRSAVIRLSLINY

SEQ ID NO: 3396466 - protein, 30 aa, Plasmodium falciparum
YSFHEGRQLALMLKYKYIKRNHTIFKNLND

SEQ ID NO: 3396467 - protein, 17 aa, Plasmodium falciparum
YSFLPTLDQDYSSILKE

SEQ ID NO: 3396468 - protein, 20 aa, Plasmodium falciparum
YSFPADIWSLGIILYELISL

SEQ ID NO: 3396469 - protein, 20 aa, Plasmodium falciparum
YSFPFCECIEKIHYSETYIS

SEQ ID NO: 3396470 - protein, 31 aa, Plasmodium falciparum
YSFSQLKHIIYSLRYILLDEHRFFCENQSMY

SEQ ID NO: 3396471 - protein, 21 aa, Plasmodium falciparum
YSFYKYIFTPNYKICFLCIHK

SEQ ID NO: 3396472 - protein, 18 aa, Plasmodium falciparum
YSGIIKKLLVKEGQFVDL

SEQ ID NO: 3396473 - protein, 19 aa, Plasmodium falciparum
YSGVKVIGPFYKKFSCIVG

SEQ ID NO: 3396474 - protein, 20 aa, Plasmodium falciparum
YSHFINIDIYYIKEKYKEIK

SEQ ID NO: 3396475 - protein, 24 aa, Plasmodium falciparum
YSICSIFYSYLKLSGDVLTNHPIK

SEQ ID NO: 3396476 - protein, 20 aa, Plasmodium falciparum
YSIDTYLKLMVFDIFKCNNE

SEQ ID NO: 3396477 - protein, 25 aa, Plasmodium falciparum
YSIDYTVGGLFLFGGFKIDIEENNG

SEQ ID NO: 3396478 - protein, 18 aa, Plasmodium falciparum
YSIISYKQNLFNNNMIKI

SEQ ID NO: 3396479 - protein, 19 aa, Plasmodium falciparum
YSIVWGLCGLLEYKDRLKV

SEQ ID NO: 3396480 - protein, 26 aa, Plasmodium falciparum
YSKEELIHIIALLKKENQRLKMCDTH

SEQ ID NO: 3396481 - protein, 20 aa, Plasmodium falciparum
YSKFFLTINDEYLEMLKQII

SEQ ID NO: 3396482 - protein, 17 aa, Plasmodium falciparum
YSKIINIRFIYSTDMLK

SEQ ID NO: 3396483 - protein, 17 aa, Plasmodium falciparum
YSKKKKKTFLNRNYVTF

SEQ ID NO: 3396484 - protein, 17 aa, Plasmodium falciparum
YSKKLIHPNILKVLDTY

SEQ ID NO: 3396485 - protein, 24 aa, Plasmodium falciparum
YSKLRKDWWTANRETVWKAITRSD

SEQ ID NO: 3396486 - protein, 33 aa, Plasmodium falciparum
YSKNKDIFKEPLILAYILSKKLHKQLYRDFKIL

SEQ ID NO: 3396487 - protein, 18 aa, Plasmodium falciparum
YSLFASLLPILYASLESV

SEQ ID NO: 3396488 - protein, 29 aa, Plasmodium falciparum
YSLGKIAHIIYLCLYNGLLLEENQKIIPA

SEQ ID NO: 3396489 - protein, 20 aa, Plasmodium falciparum
YSLSGFLYHKLLGHDISEDS

SEQ ID NO: 3396490 - protein, 28 aa, Plasmodium falciparum
YSNDVKRLFREKYFLQDLCEKRKVMIQK

SEQ ID NO: 3396491 - protein, 30 aa, Plasmodium falciparum
YSNEKEAINAIYFIDGMTLDNKILKASFGT

SEQ ID NO: 3396492 - protein, 23 aa, Plasmodium falciparum
YSNELYPNKIYVDTMYTYDNYPN

SEQ ID NO: 3396493 - protein, 33 aa, Plasmodium falciparum
YSNETEILLLNKYVILCLSVNDIVIYIIGDDND

SEQ ID NO: 3396494 - protein, 17 aa, Plasmodium falciparum
YSNIRPFKWRASRVLEP

SEQ ID NO: 3396495 - protein, 37 aa, Plasmodium falciparum
YSNMYCSYMMKLSKKILGFPLIKDFSKGLSTLEPSLP

SEQ ID NO: 3396496 - protein, 47 aa, Plasmodium falciparum
YSNNNPCYMDLLKNSKFKYFLNYENIHKMFDTLPKYNYTASDEDNKN

SEQ ID NO: 3396497 - protein, 26 aa, Plasmodium falciparum
YSNREEKIFLMKNRFKYINHTKNSYF

SEQ ID NO: 3396498 - protein, 19 aa, Plasmodium falciparum
YSNRFFFLDNDMNGSLHQS

SEQ ID NO: 3396499 - protein, 18 aa, Plasmodium falciparum
YSNSFYSTLLIIKDFNVL

SEQ ID NO: 3396500 - protein, 26 aa, Plasmodium falciparum
YSPKEKMFPHFLWSPDDKYIACIGKQ

SEQ ID NO: 3396501 - protein, 21 aa, Plasmodium falciparum
YSPNILLTLNKNKQIIAIPSN

SEQ ID NO: 3396502 - protein, 21 aa, Plasmodium falciparum
YSPQYGIRYDGIYKIINAFTI

SEQ ID NO: 3396503 - protein, 18 aa, Plasmodium falciparum
YSQLKKWHSNFNYEEIVF

SEQ ID NO: 3396504 - protein, 18 aa, Plasmodium falciparum
YSRCYKYLREYESCVQRI

SEQ ID NO: 3396505 - protein, 25 aa, Plasmodium falciparum
YSSKEYLFICKLFFDKVEIYLNKQT

SEQ ID NO: 3396506 - protein, 25 aa, Plasmodium falciparum
YSSKYQWILILWAPEKNSILIDDIH

SEQ ID NO: 3396507 - protein, 31 aa, Plasmodium falciparum
YSSYNSLKINLFFLFDDMYDKFFIENYQDRE

SEQ ID NO: 3396508 - protein, 24 aa, Plasmodium falciparum
YSTNNFVYVIFKRQVYKINDNGNK

SEQ ID NO: 3396509 - protein, 22 aa, Plasmodium falciparum
YSVNCIYCYNYFLYSGASDCLI

SEQ ID NO: 3396510 - protein, 19 aa, Plasmodium falciparum
YSYEKFIHKKIYSSNDVYL

SEQ ID NO: 3396511 - protein, 22 aa, Plasmodium falciparum
YSYHTILSYKYAFKAYHHNDKD

SEQ ID NO: 3396512 - protein, 23 aa, Plasmodium falciparum
YSYIRNIFYEKVDGILLVYDSSN

SEQ ID NO: 3396513 - protein, 17 aa, Plasmodium falciparum
YSYKISYSFNPCYMDYL

SEQ ID NO: 3396514 - protein, 38 aa, Plasmodium falciparum
YTAKYEVQIDPFNGFDIAKRIIGLKGTNMKKICIDTDC

SEQ ID NO: 3396515 - protein, 18 aa, Plasmodium falciparum
YTAVQICSYILKLKNKGD

SEQ ID NO: 3396516 - protein, 19 aa, Plasmodium falciparum
YTCPGCSQTFVIYKDYIEH

SEQ ID NO: 3396517 - protein, 24 aa, Plasmodium falciparum
YTDAYVIKDCKVAYVYSSCKLIKA

SEQ ID NO: 3396518 - protein, 35 aa, Plasmodium falciparum
YTDCNVDNIVILNFLKTLYVNNTNLIYPLVEQYTK

SEQ ID NO: 3396519 - protein, 33 aa, Plasmodium falciparum
YTDGHIQILFCDGKRKEILPNREEYVILRNGTI

SEQ ID NO: 3396520 - protein, 24 aa, Plasmodium falciparum
YTDIKFIKLCHVLAKKTKKYSGAE

SEQ ID NO: 3396521 - protein, 21 aa, Plasmodium falciparum
YTDILFRMDNIYNLFLETQKK

SEQ ID NO: 3396522 - protein, 31 aa, Plasmodium falciparum
YTDLDVLVGIFPIIWEYINQLPFDKESWIEN

SEQ ID NO: 3396523 - protein, 32 aa, Plasmodium falciparum
YTDLVDLMNYNNFFIKDCIVTFIFVDKDVYKG

SEQ ID NO: 3396524 - protein, 23 aa, Plasmodium falciparum
YTDTSSILLNRKIPEISGEKENY

SEQ ID NO: 3396525 - protein, 25 aa, Plasmodium falciparum
YTDYDLEQIILRNFDLRPGFIIQEL

SEQ ID NO: 3396526 - protein, 29 aa, Plasmodium falciparum
YTEEKRWKHDLFYDYKYDEYVKRDNKNHN

SEQ ID NO: 3396527 - protein, 24 aa, Plasmodium falciparum
YTESAIGLGFRKNGYINDCDLVNN

SEQ ID NO: 3396528 - protein, 18 aa, Plasmodium falciparum
YTGILKILKKKEILRWVV

SEQ ID NO: 3396529 - protein, 24 aa, Plasmodium falciparum
YTGLGTCIFFRFHKNKKTQEKYYG

SEQ ID NO: 3396530 - protein, 32 aa, Plasmodium falciparum
YTGPFLLHEYYDPFHFKFKELSRIGGVLFVEG

SEQ ID NO: 3396531 - protein, 26 aa, Plasmodium falciparum
YTHRKVRAMELMLCDGFRLADDIFKW

SEQ ID NO: 3396532 - protein, 26 aa, Plasmodium falciparum
YTIIKIIKCINFFPNDILFSKSDHII

SEQ ID NO: 3396533 - protein, 30 aa, Plasmodium falciparum
YTISKQIVDLLKLRLLINHSSLLPNSWTEK

SEQ ID NO: 3396534 - protein, 25 aa, Plasmodium falciparum
YTKAYDIYNLLKNNIYYLNKTIDIP

SEQ ID NO: 3396535 - protein, 32 aa, Plasmodium falciparum
YTKKIKEVIFHKLILQLSRVYSYISIDYFIEN

SEQ ID NO: 3396536 - protein, 26 aa, Plasmodium falciparum
YTKNILSLKNLIYSSFFLYSTMNKVI

SEQ ID NO: 3396537 - protein, 26 aa, Plasmodium falciparum
YTKQFAHFLLCLLMDISIFQIDGNFT

SEQ ID NO: 3396538 - protein, 18 aa, Plasmodium falciparum
YTLLPWKENVTIKKIEAK

SEQ ID NO: 3396539 - protein, 17 aa, Plasmodium falciparum
YTLLRNNNYIDGIPIGV

SEQ ID NO: 3396540 - protein, 17 aa, Plasmodium falciparum
YTMENLQKLIIGFDVWF

SEQ ID NO: 3396541 - protein, 17 aa, Plasmodium falciparum
YTMIKNNTINNLNFIDK

SEQ ID NO: 3396542 - protein, 31 aa, Plasmodium falciparum
YTMILQLLHSIPVYVFPYTNNPYYLIDFFNI

SEQ ID NO: 3396543 - protein, 23 aa, Plasmodium falciparum
YTNDHGFYNKAKYLKFTDLKNES

SEQ ID NO: 3396544 - protein, 27 aa, Plasmodium falciparum
YTNGKFIYTYFLYILGNLQHIYNYNFF

SEQ ID NO: 3396545 - protein, 33 aa, Plasmodium falciparum
YTNKSIYCINSFKKWIYFGSINNKCYLYNNFDD

SEQ ID NO: 3396546 - protein, 29 aa, Plasmodium falciparum
YTNNMCPHPGRRSIYNHFSHAHISNSNNM

SEQ ID NO: 3396547 - protein, 32 aa, Plasmodium falciparum
YTNQNDIINLFKQYGILKRVSFSPYNNICIIQ

SEQ ID NO: 3396548 - protein, 24 aa, Plasmodium falciparum
YTNTYILIFIYRKKPNITSGRTNL

SEQ ID NO: 3396549 - protein, 23 aa, Plasmodium falciparum
YTQHAYMRLHACSGMIIGIDENN

SEQ ID NO: 3396550 - protein, 23 aa, Plasmodium falciparum
YTQKDDFLFKEKMSYKFIELQTI

SEQ ID NO: 3396551 - protein, 28 aa, Plasmodium falciparum
YTQRKYEDILFYLPQLSQISLVRYESSS

SEQ ID NO: 3396552 - protein, 17 aa, Plasmodium falciparum
YTSFMGMKSYPVAPPPN

SEQ ID NO: 3396553 - protein, 18 aa, Plasmodium falciparum
YTSIYNLTAKKRLLLSGT

SEQ ID NO: 3396554 - protein, 24 aa, Plasmodium falciparum
YTSKYYEGTIKYFYKYLPENKKEV

SEQ ID NO: 3396555 - protein, 18 aa, Plasmodium falciparum
YTSNFYLQLEREGVVPNK

SEQ ID NO: 3396556 - protein, 23 aa, Plasmodium falciparum
YTSNIYYRRVLSGEFFVVNPHLL

SEQ ID NO: 3396557 - protein, 18 aa, Plasmodium falciparum
YTYDPNNSTYILQTSNRN

SEQ ID NO: 3396558 - protein, 18 aa, Plasmodium falciparum
YTYGFEIYTLLWSRNNEY

SEQ ID NO: 3396559 - protein, 18 aa, Plasmodium falciparum
YVCFFRGIKTSHIISNDI

SEQ ID NO: 3396560 - protein, 18 aa, Plasmodium falciparum
YVCGSDDNMFLNKKKRSC

SEQ ID NO: 3396561 - protein, 19 aa, Plasmodium falciparum
YVDGKLFNVIKYPHEYMSE

SEQ ID NO: 3396562 - protein, 25 aa, Plasmodium falciparum
YVDGVEITLLDTPYLFFNAHKDKNK

SEQ ID NO: 3396563 - protein, 25 aa, Plasmodium falciparum
YVDSEDFLFLLYTSGSTGKPKGVAH

SEQ ID NO: 3396564 - protein, 31 aa, Plasmodium falciparum
YVDVIYNDLYLYDFYNNKWIELYPYSENEKN

SEQ ID NO: 3396565 - protein, 25 aa, Plasmodium falciparum
YVEFIKYIFLMNINLQQYDLFVYDI

SEQ ID NO: 3396566 - protein, 19 aa, Plasmodium falciparum
YVEFNLLYDRGTKFGIELN

SEQ ID NO: 3396567 - protein, 29 aa, Plasmodium falciparum
YVEKSHNYLLYLFSKYNITIRKCKRFSFG

SEQ ID NO: 3396568 - protein, 17 aa, Plasmodium falciparum
YVELGCLGVWKLSSFKN

SEQ ID NO: 3396569 - protein, 19 aa, Plasmodium falciparum
YVELKGRLRLCSKSLIFEA

SEQ ID NO: 3396570 - protein, 17 aa, Plasmodium falciparum
YVELLESCGLCINNLYN

SEQ ID NO: 3396571 - protein, 23 aa, Plasmodium falciparum
YVESSFWCFDALYIPQQHPSRDL

SEQ ID NO: 3396572 - protein, 20 aa, Plasmodium falciparum
YVEVPVEVPCLYPPKIMPKV

SEQ ID NO: 3396573 - protein, 26 aa, Plasmodium falciparum
YVGFRTVMGLFLLITGRPCSLQRICQ

SEQ ID NO: 3396574 - protein, 19 aa, Plasmodium falciparum
YVGTYFKNKPKFKGNFLFS

SEQ ID NO: 3396575 - protein, 17 aa, Plasmodium falciparum
YVHLINIAALIHVQGIK

SEQ ID NO: 3396576 - protein, 29 aa, Plasmodium falciparum
YVHNLKINKIYYLFNFKVAFIDANHCPGS

SEQ ID NO: 3396577 - protein, 21 aa, Plasmodium falciparum
YVIDDFVLVKILSNESLHYIP

SEQ ID NO: 3396578 - protein, 24 aa, Plasmodium falciparum
YVIEPFDFLFYDQVYNEIYNYLQM

SEQ ID NO: 3396579 - protein, 24 aa, Plasmodium falciparum
YVIKLYVYFFVHTSNIYLNYNVLN

SEQ ID NO: 3396580 - protein, 19 aa, Plasmodium falciparum
YVILSFFDLKKYICYYSIA

SEQ ID NO: 3396581 - protein, 31 aa, Plasmodium falciparum
YVKDIHSCSYFISLLIRNIAYTNKIYKYTAQ

SEQ ID NO: 3396582 - protein, 25 aa, Plasmodium falciparum
YVKGCTHFLNLNKFNDALSCLSKLQ

SEQ ID NO: 3396583 - protein, 25 aa, Plasmodium falciparum
YVKGDFLFNMYLKSDNLNFFQLLKR

SEQ ID NO: 3396584 - protein, 27 aa, Plasmodium falciparum
YVKKSIPLFFTYLLYINNIDMKNKIIY

SEQ ID NO: 3396585 - protein, 17 aa, Plasmodium falciparum
YVKNNNIIYYEDNKFVH

SEQ ID NO: 3396586 - protein, 17 aa, Plasmodium falciparum
YVKYALDLICPLSCIIT

SEQ ID NO: 3396587 - protein, 25 aa, Plasmodium falciparum
YVKYNDFLDYMISLNIEDLFGSLEN

SEQ ID NO: 3396588 - protein, 30 aa, Plasmodium falciparum
YVLAYDNFTFKLLLFEPLKKKKHFTLTNDI

SEQ ID NO: 3396589 - protein, 17 aa, Plasmodium falciparum
YVLISVGASKKKQKNHN

SEQ ID NO: 3396590 - protein, 32 aa, Plasmodium falciparum
YVLKKRIKKLPFFRYGHFLCLTKNGCILAIGG

SEQ ID NO: 3396591 - protein, 28 aa, Plasmodium falciparum
YVLNQNSLPLLLKILRTSHKRTLIRNAA

SEQ ID NO: 3396592 - protein, 17 aa, Plasmodium falciparum
YVMKNGCEYFISDVKDK

SEQ ID NO: 3396593 - protein, 25 aa, Plasmodium falciparum
YVNDKNCFFLQYKNVESAINARNHM

SEQ ID NO: 3396594 - protein, 43 aa, Plasmodium falciparum
YVNHFNPMKSYPKKDLFIGLNVQSILPLFYIKQKYNKHNFISI

SEQ ID NO: 3396595 - protein, 28 aa, Plasmodium falciparum
YVNKIKLGFKYKLLNRYLIEFAHPFIHV

SEQ ID NO: 3396596 - protein, 18 aa, Plasmodium falciparum
YVNKINYNNLIKNRLDKL

SEQ ID NO: 3396597 - protein, 20 aa, Plasmodium falciparum
YVNYEKLPLLPNLVPSLIIK

SEQ ID NO: 3396598 - protein, 17 aa, Plasmodium falciparum
YVNYYMNMYKNYKSFNG

SEQ ID NO: 3396599 - protein, 17 aa, Plasmodium falciparum
YVRFNYNILYNSYCLFS

SEQ ID NO: 3396600 - protein, 22 aa, Plasmodium falciparum
YVRKNRIDPLFNNIIIAGINSQ

SEQ ID NO: 3396601 - protein, 41 aa, Plasmodium falciparum
YVSFIEPNPFYKDIILFGCFRKYIYLLNVEKKKIIKKFSYD

SEQ ID NO: 3396602 - protein, 18 aa, Plasmodium falciparum
YVSKIFKYKPKLVQVELY

SEQ ID NO: 3396603 - protein, 18 aa, Plasmodium falciparum
YVSLCYILDAYRKLAKKK

SEQ ID NO: 3396604 - protein, 23 aa, Plasmodium falciparum
YVSREHCLIYYDGSKDAGERWLL

SEQ ID NO: 3396605 - protein, 19 aa, Plasmodium falciparum
YVTHITNLYLFHVDLNKFS

SEQ ID NO: 3396606 - protein, 29 aa, Plasmodium falciparum
YVTTRLNKIQFLLKIFLSNIYDINSFNLL

SEQ ID NO: 3396607 - protein, 33 aa, Plasmodium falciparum
YVVHIDSIHKWIFKIKNLFLSNITINYITKRFP

SEQ ID NO: 3396608 - protein, 17 aa, Plasmodium falciparum
YVVIYNIGKKKNVGCIV

SEQ ID NO: 3396609 - protein, 17 aa, Plasmodium falciparum
YVYAKYKTIYLKKCFDN

SEQ ID NO: 3396610 - protein, 24 aa, Plasmodium falciparum
YVYEYDRIFLLDKNFNFYSFFLPI

SEQ ID NO: 3396611 - protein, 21 aa, Plasmodium falciparum
YVYHYPFKRHMSYNSLPCNIK

SEQ ID NO: 3396612 - protein, 23 aa, Plasmodium falciparum
YVYNLINYNIWNNVVPYNNNLYN

SEQ ID NO: 3396613 - protein, 19 aa, Plasmodium falciparum
YWENMNPRKYVSIVPTSAI

SEQ ID NO: 3396614 - protein, 23 aa, Plasmodium falciparum
YWNMLHYNNYSLRRSKSKKWISQ

SEQ ID NO: 3396615 - protein, 17 aa, Plasmodium falciparum
YWPLEEIILPKKIQNVQ

SEQ ID NO: 3396616 - protein, 22 aa, Plasmodium falciparum
YWPSKWKWYHRHGYWATRKKLL

SEQ ID NO: 3396617 - protein, 27 aa, Plasmodium falciparum
YWRNKPYIFYVHFPICLYVLDILNNNN

SEQ ID NO: 3396618 - protein, 24 aa, Plasmodium falciparum
YYADLYFFNDITLIRFLDTYNYNM

SEQ ID NO: 3396619 - protein, 19 aa, Plasmodium falciparum
YYDFSENDFKFLFKSDNED

SEQ ID NO: 3396620 - protein, 20 aa, Plasmodium falciparum
YYDKIYINLKNNFHTLCLLD

SEQ ID NO: 3396621 - protein, 18 aa, Plasmodium falciparum
YYDLLLYISYADEDDRGC

SEQ ID NO: 3396622 - protein, 23 aa, Plasmodium falciparum
YYDNNFGPVLLFGSGGSYVEIFK

SEQ ID NO: 3396623 - protein, 28 aa, Plasmodium falciparum
YYDRENKILLWLLYQQGVVQIKNIHILT

SEQ ID NO: 3396624 - protein, 22 aa, Plasmodium falciparum
YYDTFVLYLDFNSLYPSIIIEY

SEQ ID NO: 3396625 - protein, 20 aa, Plasmodium falciparum
YYDYNNFHYNYGYGGDDEYP

SEQ ID NO: 3396626 - protein, 19 aa, Plasmodium falciparum
YYEILYVKRYFYISEIKRE

SEQ ID NO: 3396627 - protein, 24 aa, Plasmodium falciparum
YYEIMDMYCWLYTKFPDVYKNINL

SEQ ID NO: 3396628 - protein, 24 aa, Plasmodium falciparum
YYEKDLFHFIIEYFSHENNYISLD

SEQ ID NO: 3396629 - protein, 23 aa, Plasmodium falciparum
YYENIRIEPPFYFTKDTFNLFIN

SEQ ID NO: 3396630 - protein, 17 aa, Plasmodium falciparum
YYENNMIQFVDKNNLVT

SEQ ID NO: 3396631 - protein, 54 aa, Plasmodium falciparum
YYERRMLKNMNLKYNILKINKYILSCNNIYKYAKMKYILQSVFNKILTNKNIMD

SEQ ID NO: 3396632 - protein, 21 aa, Plasmodium falciparum
YYESFFIPKNLTEFNFKDNDK

SEQ ID NO: 3396633 - protein, 20 aa, Plasmodium falciparum
YYESLTKLVNLKNKKKIKKK

SEQ ID NO: 3396634 - protein, 18 aa, Plasmodium falciparum
YYEYISNDLYNILNKNLY

SEQ ID NO: 3396635 - protein, 45 aa, Plasmodium falciparum
YYFIEDDYLIFSPYMFIIVNGIQIPLNTPLYWLAANFSQFDHFLH

SEQ ID NO: 3396636 - protein, 26 aa, Plasmodium falciparum
YYGKKCFRNWLYLSRIAATKEYAYLK

SEQ ID NO: 3396637 - protein, 20 aa, Plasmodium falciparum
YYHDNMHNLYPINNIPSNYN

SEQ ID NO: 3396638 - protein, 18 aa, Plasmodium falciparum
YYHLEPLIYNFIKTLKKK

SEQ ID NO: 3396639 - protein, 18 aa, Plasmodium falciparum
YYIDQLKENIKKIKSLKE

SEQ ID NO: 3396640 - protein, 44 aa, Plasmodium falciparum
YYIDYNYKFMIYTFFKWLLENPFIYKLFFNFPSDIKIMSSYFQN

SEQ ID NO: 3396641 - protein, 29 aa, Plasmodium falciparum
YYIIKDHIYYNIKLLYKILDYKNERLVIH

SEQ ID NO: 3396642 - protein, 19 aa, Plasmodium falciparum
YYINKDILNYIFSDTLNVR

SEQ ID NO: 3396643 - protein, 33 aa, Plasmodium falciparum
YYKGLEYIPELLRNRFFSMYNKYQLRAINNSIL

SEQ ID NO: 3396644 - protein, 19 aa, Plasmodium falciparum
YYKKILIHFIQNNIILTNS

SEQ ID NO: 3396645 - protein, 26 aa, Plasmodium falciparum
YYKKTEYFLLNKLIYHLFKCASHLLK

SEQ ID NO: 3396646 - protein, 24 aa, Plasmodium falciparum
YYKKTYFDLYQRCLDIYLCSRTLK

SEQ ID NO: 3396647 - protein, 26 aa, Plasmodium falciparum
YYKLGNICTLLLKSGYAYINEYTIKF

SEQ ID NO: 3396648 - protein, 25 aa, Plasmodium falciparum
YYKLKYILTHELIHAFDFARANIDM

SEQ ID NO: 3396649 - protein, 25 aa, Plasmodium falciparum
YYKNILRKYFHYVKKYKHHQKKKKE

SEQ ID NO: 3396650 - protein, 17 aa, Plasmodium falciparum
YYKWFDKKKIFVMQIHF

SEQ ID NO: 3396651 - protein, 19 aa, Plasmodium falciparum
YYKYHNNISFINYTDMVYL

SEQ ID NO: 3396652 - protein, 18 aa, Plasmodium falciparum
YYKYNYFLDPYNKKLGVS

SEQ ID NO: 3396653 - protein, 21 aa, Plasmodium falciparum
YYKYVFTDNYYDLLLYISYAD

SEQ ID NO: 3396654 - protein, 18 aa, Plasmodium falciparum
YYLIKWKDIVKPENEILY

SEQ ID NO: 3396655 - protein, 19 aa, Plasmodium falciparum
YYLKYKSILKKRITSKILC

SEQ ID NO: 3396656 - protein, 19 aa, Plasmodium falciparum
YYLTRDLLLYEFYCINHMD

SEQ ID NO: 3396657 - protein, 17 aa, Plasmodium falciparum
YYMLCKVEEKKKADPSF

SEQ ID NO: 3396658 - protein, 27 aa, Plasmodium falciparum
YYMSQRQKIIWRKWIAKHTIRVREFVI

SEQ ID NO: 3396659 - protein, 26 aa, Plasmodium falciparum
YYNDERYIFMFSKKNKDYYNHSYGSK

SEQ ID NO: 3396660 - protein, 24 aa, Plasmodium falciparum
YYNGYVNLNKVPLFLSERHSSFYG

SEQ ID NO: 3396661 - protein, 19 aa, Plasmodium falciparum
YYNHINDSYYYQFNDLHSK

SEQ ID NO: 3396662 - protein, 20 aa, Plasmodium falciparum
YYNLKNNIYNKPTSLTYIND

SEQ ID NO: 3396663 - protein, 20 aa, Plasmodium falciparum
YYNNRYRYNNYRRSNRRNMD

SEQ ID NO: 3396664 - protein, 18 aa, Plasmodium falciparum
YYNVKGRNPSIIRKIIWK

SEQ ID NO: 3396665 - protein, 17 aa, Plasmodium falciparum
YYPIKESLLNAYDTYFC

SEQ ID NO: 3396666 - protein, 27 aa, Plasmodium falciparum
YYQINDIHNIVALFKEFKIYDCKHVLK

SEQ ID NO: 3396667 - protein, 26 aa, Plasmodium falciparum
YYREKKILRKIYKYIKIYKNKKNMKL

SEQ ID NO: 3396668 - protein, 21 aa, Plasmodium falciparum
YYRIPNFFRNKSEYVLYFMNS

SEQ ID NO: 3396669 - protein, 29 aa, Plasmodium falciparum
YYSCIYPFNMPISLYKYPPIFGYCSLSDF

SEQ ID NO: 3396670 - protein, 19 aa, Plasmodium falciparum
YYSFFVECKDPHACTILLR

SEQ ID NO: 3396671 - protein, 31 aa, Plasmodium falciparum
YYSINLKYHFIIPDIFLYYKQLRFEGVELKT

SEQ ID NO: 3396672 - protein, 18 aa, Plasmodium falciparum
YYSKINYINKTDGSFNPP

SEQ ID NO: 3396673 - protein, 17 aa, Plasmodium falciparum
YYSKYFGYYLTGDMSTE

SEQ ID NO: 3396674 - protein, 17 aa, Plasmodium falciparum
YYSLKLPKFIDVCLDIK

SEQ ID NO: 3396675 - protein, 17 aa, Plasmodium falciparum
YYTLGYHETYSERKYID

SEQ ID NO: 3396676 - protein, 28 aa, Plasmodium falciparum
YYTYVNRLVYFLFMKTNYYGIENFLSHH

SEQ ID NO: 3396677 - protein, 26 aa, Plasmodium falciparum
YYVTSASHMISLLNILIHAKKADNTI

SEQ ID NO: 3396678 - protein, 34 aa, Plasmodium falciparum
YYYDINVYQFYMNLILYSKIDLIKMYKNKIFSVQ

SEQ ID NO: 3396679 - protein, 19 aa, Plasmodium falciparum
YYYLSIDNLYLYLEILHRM

SEQ ID NO: 3396680 - protein, 17 aa, Plasmodium falciparum
YYYTMRKMLFKTYRHLL

SEQ ID NO: 3396681 - protein, 17 aa, Plasmodium falciparum
YYYVYRLVNMKKNCDYN

SEQ ID NO: 3396682 - protein, 22 aa, Plasmodium falciparum
EKSHTKKKKSSWLKFGRGNKND

SEQ ID NO: 3396683 - protein, 22 aa, Plasmodium falciparum
AAQRIYLMALQRNFTMGRNNSY

SEQ ID NO: 3396684 - protein, 19 aa, Plasmodium falciparum
KHCLKFLKFLIIHGNKYKG

SEQ ID NO: 3396685 - protein, 22 aa, Plasmodium falciparum
QTPVKPLGKTFLKLLRLLHINV

SEQ ID NO: 3396686 - protein, 24 aa, Plasmodium falciparum
RHDLYLLFLLKFISGVIPTIEYDF

SEQ ID NO: 3396687 - protein, 27 aa, Plasmodium falciparum
ADKFMLGVFFFWIWTNGNLWKCSDPLQ

SEQ ID NO: 3396688 - protein, 23 aa, Plasmodium falciparum
AFVLRKLLARKLQLGYTPPLKFV

SEQ ID NO: 3396689 - protein, 23 aa, Plasmodium falciparum
AHFPNSYMLFRFVNKGIYQVNIP

SEQ ID NO: 3396690 - protein, 28 aa, Plasmodium falciparum
AHINISLLPEKWYCSLNFWNAYNNCDME

SEQ ID NO: 3396691 - protein, 19 aa, Plasmodium falciparum
AIFNSYFLKDILQNGKDKG

SEQ ID NO: 3396692 - protein, 19 aa, Plasmodium falciparum
AIYPFFQKLFHLFYAHYEK

SEQ ID NO: 3396693 - protein, 29 aa, Plasmodium falciparum
AKTHGFYKSKFWAIKVRLSKVKGQTIFGK

SEQ ID NO: 3396694 - protein, 21 aa, Plasmodium falciparum
AKYDYIFKKLSYYITLKKEID

SEQ ID NO: 3396695 - protein, 17 aa, Plasmodium falciparum
ALLKFVLFKLYKLDNML

SEQ ID NO: 3396696 - protein, 18 aa, Plasmodium falciparum
ALNKLFPPPLKPFTVVPK

SEQ ID NO: 3396697 - protein, 25 aa, Plasmodium falciparum
ALNNKDVFILLKNRILLIAIDEVHC

SEQ ID NO: 3396698 - protein, 21 aa, Plasmodium falciparum
AMYEKLFLWIIRHLNSRIEPE

SEQ ID NO: 3396699 - protein, 21 aa, Plasmodium falciparum
ANRIFIVDPWWNPAAELQAIQ

SEQ ID NO: 3396700 - protein, 20 aa, Plasmodium falciparum
ANRNIIEVMFYILENNKLIN

SEQ ID NO: 3396701 - protein, 24 aa, Plasmodium falciparum
ASDKFTLFLTIEGILYGVGLINEH

SEQ ID NO: 3396702 - protein, 29 aa, Plasmodium falciparum
AVKHFLYQNILKKNFILFNIFKGGKNSNN

SEQ ID NO: 3396703 - protein, 18 aa, Plasmodium falciparum
AYLINHLPLGISLTEVVD

SEQ ID NO: 3396704 - protein, 22 aa, Plasmodium falciparum
AYYEELDYLYKLLIQKKKNILG

SEQ ID NO: 3396705 - protein, 18 aa, Plasmodium falciparum
CCLLFYPLNYTFVCPTEI

SEQ ID NO: 3396706 - protein, 18 aa, Plasmodium falciparum
CCSYILRFEGPPPHFLII

SEQ ID NO: 3396707 - protein, 23 aa, Plasmodium falciparum
CCTFGYYYFETFLFRNNKMIPKL

SEQ ID NO: 3396708 - protein, 24 aa, Plasmodium falciparum
CDCGYQICLWCLYYIRDHMNNTCP

SEQ ID NO: 3396709 - protein, 23 aa, Plasmodium falciparum
CDFKKDFFLWKPFIIFSDKNIIK

SEQ ID NO: 3396710 - protein, 25 aa, Plasmodium falciparum
CENFSILFKIFYDSLIYIVKKNEEA

SEQ ID NO: 3396711 - protein, 17 aa, Plasmodium falciparum
CFKMLKSIDIYITEIIM

SEQ ID NO: 3396712 - protein, 18 aa, Plasmodium falciparum
CGFLYLRYVHSPANLWMW

SEQ ID NO: 3396713 - protein, 23 aa, Plasmodium falciparum
CGKRIIGFLSASGKIYCWHLNEL

SEQ ID NO: 3396714 - protein, 19 aa, Plasmodium falciparum
CHYMSLIFLYIKNLFYLQE

SEQ ID NO: 3396715 - protein, 21 aa, Plasmodium falciparum
CIFLDPFILNLLFYEYDQDMN

SEQ ID NO: 3396716 - protein, 19 aa, Plasmodium falciparum
CIILNEIIKFLFLNDEYVL

SEQ ID NO: 3396717 - protein, 25 aa, Plasmodium falciparum
CIPLFQRLQQNLFFLVMLANQPEDN

SEQ ID NO: 3396718 - protein, 25 aa, Plasmodium falciparum
CKDMKPYMRLFNIVLKVIESNDYNV

SEQ ID NO: 3396719 - protein, 19 aa, Plasmodium falciparum
CKRRIFLNTYSLSLNGKYL

SEQ ID NO: 3396720 - protein, 18 aa, Plasmodium falciparum
CLNDIIFLDVYRAYNVLT

SEQ ID NO: 3396721 - protein, 22 aa, Plasmodium falciparum
CNIAPTFWLFFGLQSYYNYKYY

SEQ ID NO: 3396722 - protein, 23 aa, Plasmodium falciparum
CNNSYFRFYLLNGLSISIHHLEM

SEQ ID NO: 3396723 - protein, 23 aa, Plasmodium falciparum
CPKNFFLFFYYKSKNNLFNYKDM

SEQ ID NO: 3396724 - protein, 33 aa, Plasmodium falciparum
CQKYDHYILAKKLIEQLLVKIYMDYDTWLFNHG

SEQ ID NO: 3396725 - protein, 17 aa, Plasmodium falciparum
CSFIKYYDKLKNDLLNE

SEQ ID NO: 3396726 - protein, 17 aa, Plasmodium falciparum
CTCYLFMWLPFECAVIK

SEQ ID NO: 3396727 - protein, 17 aa, Plasmodium falciparum
CTKYFMDNFLSLIDKKI

SEQ ID NO: 3396728 - protein, 26 aa, Plasmodium falciparum
CTNIIDLVPYFFIFKNIIKQKTLPST

SEQ ID NO: 3396729 - protein, 24 aa, Plasmodium falciparum
CYESLIILYFLYSLVRYHECDFIL

SEQ ID NO: 3396730 - protein, 25 aa, Plasmodium falciparum
DAWSIGIILYLLLSGKLPFPINKNT

SEQ ID NO: 3396731 - protein, 24 aa, Plasmodium falciparum
DDKFTLYLHILKKFPYLFDLNISD

SEQ ID NO: 3396732 - protein, 22 aa, Plasmodium falciparum
DDKKKFWRFPFGKKKETKDANE

SEQ ID NO: 3396733 - protein, 23 aa, Plasmodium falciparum
DDSYFIIPFFTSYGKFLIIIKTN

SEQ ID NO: 3396734 - protein, 35 aa, Plasmodium falciparum
DEDKVLYSFPFKYFHLLVYAFKNYYFNIYLKKVHN

SEQ ID NO: 3396735 - protein, 20 aa, Plasmodium falciparum
DEGLRFLYVIRLLEFFHEKK

SEQ ID NO: 3396736 - protein, 25 aa, Plasmodium falciparum
DEKMKNFLYLFYTNKVLLQEKEELQ

SEQ ID NO: 3396737 - protein, 23 aa, Plasmodium falciparum
DENWLIKLLIYMNSLLQLERLRL

SEQ ID NO: 3396738 - protein, 19 aa, Plasmodium falciparum
DERTLLFKLIIYYKNINYN

SEQ ID NO: 3396739 - protein, 21 aa, Plasmodium falciparum
DEVFVYFFSQKKWYLLKGKLC

SEQ ID NO: 3396740 - protein, 17 aa, Plasmodium falciparum
DFAYLLKILTCSALPHN

SEQ ID NO: 3396741 - protein, 19 aa, Plasmodium falciparum
DFIFFRKFFLIYNMDKLLS

SEQ ID NO: 3396742 - protein, 17 aa, Plasmodium falciparum
DFLFLINAKLYDTIKNK

SEQ ID NO: 3396743 - protein, 20 aa, Plasmodium falciparum
DFLINIILRWNYYTSLKSEK

SEQ ID NO: 3396744 - protein, 25 aa, Plasmodium falciparum
DFYKNNFLPFFYIPCNYLFIKNYCN

SEQ ID NO: 3396745 - protein, 18 aa, Plasmodium falciparum
DGFKIIPSKNLSALFSGR

SEQ ID NO: 3396746 - protein, 17 aa, Plasmodium falciparum
DGMFLRLLLYNPTLEDI

SEQ ID NO: 3396747 - protein, 18 aa, Plasmodium falciparum
DHTKLSYKWDIWSMGCVF

SEQ ID NO: 3396748 - protein, 23 aa, Plasmodium falciparum
DICPFLFCYLWLKSNDYKIDKWI

SEQ ID NO: 3396749 - protein, 25 aa, Plasmodium falciparum
DIFKMKYFKKYYKFFYSLKGEEEIL

SEQ ID NO: 3396750 - protein, 24 aa, Plasmodium falciparum
DIGKGWKHFMIYDGKLRELILRKN

SEQ ID NO: 3396751 - protein, 23 aa, Plasmodium falciparum
DIIFFCFSLCIFSYICGFKSTGK

SEQ ID NO: 3396752 - protein, 17 aa, Plasmodium falciparum
DIKLILRTGGGFRKLSE

SEQ ID NO: 3396753 - protein, 20 aa, Plasmodium falciparum
DILCKFFVYIFPFIIKKLDI

SEQ ID NO: 3396754 - protein, 17 aa, Plasmodium falciparum
DILWWYKNKKKNNYKDV

SEQ ID NO: 3396755 - protein, 25 aa, Plasmodium falciparum
DILYAYEICFFIGKKLKFFKKEKSV

SEQ ID NO: 3396756 - protein, 25 aa, Plasmodium falciparum
DIMKIIFNYFYILKDNKFIKLKEFI

SEQ ID NO: 3396757 - protein, 22 aa, Plasmodium falciparum
DINMFFLPFELSTKLRFKDFKK

SEQ ID NO: 3396758 - protein, 23 aa, Plasmodium falciparum
DINSILFYYKRYYSLKKPLNEEN

SEQ ID NO: 3396759 - protein, 26 aa, Plasmodium falciparum
DIWMVGCILYLLLFKIHPFQNNNFLS

SEQ ID NO: 3396760 - protein, 24 aa, Plasmodium falciparum
DIYDFNWFYKKYKLISISLNRTYR

SEQ ID NO: 3396761 - protein, 25 aa, Plasmodium falciparum
DIYLQLFEYIWPKVMKKYKGRIIMY

SEQ ID NO: 3396762 - protein, 25 aa, Plasmodium falciparum
DKCNSHFFFTYFHKGELIEYLHNQI

SEQ ID NO: 3396763 - protein, 20 aa, Plasmodium falciparum
DKFFFVIFVTFIFNLENEYI

SEQ ID NO: 3396764 - protein, 28 aa, Plasmodium falciparum
DKKYKLVVFIYKGILLMLLIKGSKIKDE

SEQ ID NO: 3396765 - protein, 24 aa, Plasmodium falciparum
DLDNKLLNILSLSFLTFVDNVIYD

SEQ ID NO: 3396766 - protein, 19 aa, Plasmodium falciparum
DLINFYKDPINFLFICNQT

SEQ ID NO: 3396767 - protein, 20 aa, Plasmodium falciparum
DLIVMKSFWRKGQAWVVYDD

SEQ ID NO: 3396768 - protein, 21 aa, Plasmodium falciparum
DLKKYFILNNKYLIENANKYN

SEQ ID NO: 3396769 - protein, 18 aa, Plasmodium falciparum
DLLVYTKNEFLYAYKELI

SEQ ID NO: 3396770 - protein, 41 aa, Plasmodium falciparum
DLPIRFNESMPWVRFNDMFPFGSFPFVLPLTSMKKNLKNVE

SEQ ID NO: 3396771 - protein, 17 aa, Plasmodium falciparum
DLQNKIFFFLKDTIQKY

SEQ ID NO: 3396772 - protein, 18 aa, Plasmodium falciparum
DLTILREYLLKDLFFDTS

SEQ ID NO: 3396773 - protein, 19 aa, Plasmodium falciparum
DLYEKLAKLLIKKKIRQRD

SEQ ID NO: 3396774 - protein, 19 aa, Plasmodium falciparum
DMCYYLPGASRHSFSFRDN

SEQ ID NO: 3396775 - protein, 25 aa, Plasmodium falciparum
DMDMHLHYMIKFFLKLHKNFFENPL

SEQ ID NO: 3396776 - protein, 22 aa, Plasmodium falciparum
DMDNFWVIVKYLKNKSSILHED

SEQ ID NO: 3396777 - protein, 22 aa, Plasmodium falciparum
DMKFEFLWNKWKEKINNNFCDL

SEQ ID NO: 3396778 - protein, 22 aa, Plasmodium falciparum
DMKPPENILFVCKLNPVTEEED

SEQ ID NO: 3396779 - protein, 17 aa, Plasmodium falciparum
DMWFIPPKLLEDLKQGV

SEQ ID NO: 3396780 - protein, 26 aa, Plasmodium falciparum
DMYLYNYLMFYFYLNKDKILNKWKCS

SEQ ID NO: 3396781 - protein, 17 aa, Plasmodium falciparum
DNFPYLIVTLRSLVRVI

SEQ ID NO: 3396782 - protein, 22 aa, Plasmodium falciparum
DNIILTMIWNINNISLLTGSKN

SEQ ID NO: 3396783 - protein, 20 aa, Plasmodium falciparum
DNIIPKWLYFVKGVIDCEDM

SEQ ID NO: 3396784 - protein, 22 aa, Plasmodium falciparum
DNISIVIQFIKFMSFIVYEQFP

SEQ ID NO: 3396785 - protein, 25 aa, Plasmodium falciparum
DNISSVDIFYLFESYYNFEKRKKKN

SEQ ID NO: 3396786 - protein, 25 aa, Plasmodium falciparum
DNKKIYTTLIQWLLNHSPENQKQLI

SEQ ID NO: 3396787 - protein, 20 aa, Plasmodium falciparum
DNVKILIRYLGWKNYSGCIT

SEQ ID NO: 3396788 - protein, 17 aa, Plasmodium falciparum
DPHEFPKILWKSKAGGV

SEQ ID NO: 3396789 - protein, 24 aa, Plasmodium falciparum
DQNKYLYHFYKKKKVKLYLCLNKK

SEQ ID NO: 3396790 - protein, 18 aa, Plasmodium falciparum
DRFLNKANQKLYILMEFC

SEQ ID NO: 3396791 - protein, 19 aa, Plasmodium falciparum
DRKGSWLAYWSIGKNFQMR

SEQ ID NO: 3396792 - protein, 24 aa, Plasmodium falciparum
DRTKYKIQILLPPKIDPSVTMMTV

SEQ ID NO: 3396793 - protein, 19 aa, Plasmodium falciparum
DRYDVLYKKYIKLLTTYSC

SEQ ID NO: 3396794 - protein, 23 aa, Plasmodium falciparum
DSDGKIFILNMYKLIIFEQLKVQ

SEQ ID NO: 3396795 - protein, 25 aa, Plasmodium falciparum
DSFKYRYFYLPATWLLATLFPTYRQ

SEQ ID NO: 3396796 - protein, 27 aa, Plasmodium falciparum
DSINFLKALKGLPPLPFLKCKDMKPYM

SEQ ID NO: 3396797 - protein, 28 aa, Plasmodium falciparum
DSLLNHIVKMPLKYAYKNGLSPRNSTAR

SEQ ID NO: 3396798 - protein, 26 aa, Plasmodium falciparum
DSRFCFLEFRTVQITWLCLKLDSIPY

SEQ ID NO: 3396799 - protein, 24 aa, Plasmodium falciparum
DTFDFLIDLIPLEDRMKFINLHMK

SEQ ID NO: 3396800 - protein, 24 aa, Plasmodium falciparum
DTKEILAYLLPYHTYYLDEVRIAS

SEQ ID NO: 3396801 - protein, 25 aa, Plasmodium falciparum
DTKNYNIKLGWWNFGKPLKIFSNIE

SEQ ID NO: 3396802 - protein, 18 aa, Plasmodium falciparum
DVEWITPSFLFQEILKQS

SEQ ID NO: 3396803 - protein, 20 aa, Plasmodium falciparum
DVPPYCELAPLIVLTKNCQL

SEQ ID NO: 3396804 - protein, 24 aa, Plasmodium falciparum
DVYYEGFIPFFRPILNLKSKKNQD

SEQ ID NO: 3396805 - protein, 17 aa, Plasmodium falciparum
DWDMWFIPPKLLEDLKQ

SEQ ID NO: 3396806 - protein, 19 aa, Plasmodium falciparum
DYDLLYASIFYRFLKRLPC

SEQ ID NO: 3396807 - protein, 26 aa, Plasmodium falciparum
DYFIKSVPIFFFRTYIGAATKAHAYN

SEQ ID NO: 3396808 - protein, 35 aa, Plasmodium falciparum
EAAFFELLNDFFPSLYDIKYLLLNLNIKQLSRTFS

SEQ ID NO: 3396809 - protein, 17 aa, Plasmodium falciparum
ECFSVYRYGFLIARELA

SEQ ID NO: 3396810 - protein, 25 aa, Plasmodium falciparum
EDEEYILFLKYIYNDLLSFIESNKD

SEQ ID NO: 3396811 - protein, 21 aa, Plasmodium falciparum
EDFILYYPLYFKSIYNKSTDN

SEQ ID NO: 3396812 - protein, 21 aa, Plasmodium falciparum
EDKFFYIYYLYLIRKLKKENR

SEQ ID NO: 3396813 - protein, 21 aa, Plasmodium falciparum
EDLVFIPWRDSKLTRILSKSL

SEQ ID NO: 3396814 - protein, 23 aa, Plasmodium falciparum
EDRKYCFNLLYEEQPYKALLLKN

SEQ ID NO: 3396815 - protein, 25 aa, Plasmodium falciparum
EEARYLFHQILLAIKFLHSKKMALR

SEQ ID NO: 3396816 - protein, 18 aa, Plasmodium falciparum
EECCLILLKLLYVNIILN

SEQ ID NO: 3396817 - protein, 17 aa, Plasmodium falciparum
EEEILEHISWYKQFLVY

SEQ ID NO: 3396818 - protein, 22 aa, Plasmodium falciparum
EEFKLLRYYLIYDHLKYIVIRL

SEQ ID NO: 3396819 - protein, 23 aa, Plasmodium falciparum
EEKNEIFYFLLKKIITSFEKKKK

SEQ ID NO: 3396820 - protein, 24 aa, Plasmodium falciparum
EEKRWKHDLFYDYKYDEYVKRDNK

SEQ ID NO: 3396821 - protein, 21 aa, Plasmodium falciparum
EEKYILLLYISEKKLEYVWNE

SEQ ID NO: 3396822 - protein, 22 aa, Plasmodium falciparum
EELYEHFIINTFNYSKPLGCLP

SEQ ID NO: 3396823 - protein, 22 aa, Plasmodium falciparum
EENILFCFSIDKDKNRLLVCIK

SEQ ID NO: 3396824 - protein, 25 aa, Plasmodium falciparum
EENIYNYIFFFKKICKLFSTCYVNN

SEQ ID NO: 3396825 - protein, 25 aa, Plasmodium falciparum
EFDQRNLYFFISNFNLMDKIFSDSH

SEQ ID NO: 3396826 - protein, 19 aa, Plasmodium falciparum
EFFDIYKKKLFLNADILKE

SEQ ID NO: 3396827 - protein, 17 aa, Plasmodium falciparum
EFIYISNKIHFLGFRFI

SEQ ID NO: 3396828 - protein, 24 aa, Plasmodium falciparum
EFYYLTKNFFSLKKLLLVISESKL

SEQ ID NO: 3396829 - protein, 25 aa, Plasmodium falciparum
EHCIFNLFKLVLLRVSLYIGVFNTK

SEQ ID NO: 3396830 - protein, 17 aa, Plasmodium falciparum
EHISWYKQFLVYNNLKN

SEQ ID NO: 3396831 - protein, 21 aa, Plasmodium falciparum
EHKDILLKIKSLPLIQKLCLY

SEQ ID NO: 3396832 - protein, 23 aa, Plasmodium falciparum
EHPFGFFFFYFYNRGSLLVMGGK

SEQ ID NO: 3396833 - protein, 18 aa, Plasmodium falciparum
EHSPTLINFTFPSKIKKI

SEQ ID NO: 3396834 - protein, 17 aa, Plasmodium falciparum
EIKNYLETFPLPKITYL

SEQ ID NO: 3396835 - protein, 20 aa, Plasmodium falciparum
EILILLYKIIYKLNIFDINK

SEQ ID NO: 3396836 - protein, 24 aa, Plasmodium falciparum
EIPNKQWLYFLKSYKKRISKNIIV

SEQ ID NO: 3396837 - protein, 22 aa, Plasmodium falciparum
EIREWLLLFLLPNFIHKSIHKV

SEQ ID NO: 3396838 - protein, 17 aa, Plasmodium falciparum
EISPLCSFLLPMLSVDP

SEQ ID NO: 3396839 - protein, 20 aa, Plasmodium falciparum
EIWTHILIKALYKCFHIFHF

SEQ ID NO: 3396840 - protein, 17 aa, Plasmodium falciparum
EIYIYIYGKIKKSKHTN

SEQ ID NO: 3396841 - protein, 22 aa, Plasmodium falciparum
EKAYILKNWWIHNKKMICNSIN

SEQ ID NO: 3396842 - protein, 24 aa, Plasmodium falciparum
EKFNGTPFIFVYDKSINFYTYSES

SEQ ID NO: 3396843 - protein, 17 aa, Plasmodium falciparum
EKHQYMFALTFNKKVFN

SEQ ID NO: 3396844 - protein, 19 aa, Plasmodium falciparum
EKIYTKIDLLEIYLGHNWG

SEQ ID NO: 3396845 - protein, 26 aa, Plasmodium falciparum
EKKLIKLMLLVFKFTYDYKNDNNKYE

SEQ ID NO: 3396846 - protein, 17 aa, Plasmodium falciparum
EKKLSINFIWLGGLFYP

SEQ ID NO: 3396847 - protein, 22 aa, Plasmodium falciparum
EKSHTKKKKSSWLKFGRGDKND

SEQ ID NO: 3396848 - protein, 18 aa, Plasmodium falciparum
EKSYQYHIYFKHKFLKEK

SEQ ID NO: 3396849 - protein, 24 aa, Plasmodium falciparum
EKVKSRWIYLLSNNWDFFKNISSI

SEQ ID NO: 3396850 - protein, 25 aa, Plasmodium falciparum
EKYALLLRLILIFKKKKLGKTMIFF

SEQ ID NO: 3396851 - protein, 23 aa, Plasmodium falciparum
EKYIKFLSNVKIYFLKKLDDIDY

SEQ ID NO: 3396852 - protein, 20 aa, Plasmodium falciparum
EKYKYIQNIILFLDSNLYTR

SEQ ID NO: 3396853 - protein, 21 aa, Plasmodium falciparum
EKYWDNPPLHYSKKNNYDIFT

SEQ ID NO: 3396854 - protein, 20 aa, Plasmodium falciparum
EKYWFIFNDTINIEYKLYLE

SEQ ID NO: 3396855 - protein, 25 aa, Plasmodium falciparum
ELAYKYFCHVVNGLYYLNQMGIFHR

SEQ ID NO: 3396856 - protein, 17 aa, Plasmodium falciparum
ELCKKWRKLDAHINISL

SEQ ID NO: 3396857 - protein, 21 aa, Plasmodium falciparum
ELFKSFLFTYPVYYMNARQKN

SEQ ID NO: 3396858 - protein, 21 aa, Plasmodium falciparum
ELKIYILIFRSLCNENIKKID

SEQ ID NO: 3396859 - protein, 23 aa, Plasmodium falciparum
ELKKLLFNDLIYELGYILKNINL

SEQ ID NO: 3396860 - protein, 25 aa, Plasmodium falciparum
ELNIKCIWAHPFLNTKSTYYILCAF

SEQ ID NO: 3396861 - protein, 19 aa, Plasmodium falciparum
ELNWACDPLLYEELEWYLS

SEQ ID NO: 3396862 - protein, 24 aa, Plasmodium falciparum
ELRQNLFLCAINFHLNYWAEKVIL

SEQ ID NO: 3396863 - protein, 21 aa, Plasmodium falciparum
ELVKSGIISIPIVFVCIKQLL

SEQ ID NO: 3396864 - protein, 33 aa, Plasmodium falciparum
ELYKTFIYSNFLTKALILYPSLMPYVECIIEKI

SEQ ID NO: 3396865 - protein, 22 aa, Plasmodium falciparum
EMIKYLYYIFDIKELYLFLEIN

SEQ ID NO: 3396866 - protein, 25 aa, Plasmodium falciparum
EMKDKILFELLSLKFASIFNDILQL

SEQ ID NO: 3396867 - protein, 23 aa, Plasmodium falciparum
ENEKIRLYQIQRSRYYFALVECY

SEQ ID NO: 3396868 - protein, 24 aa, Plasmodium falciparum
ENIKKIDFYILKIILNELDELRKV

SEQ ID NO: 3396869 - protein, 17 aa, Plasmodium falciparum
ENILCLYPYFNDYQLRK

SEQ ID NO: 3396870 - protein, 30 aa, Plasmodium falciparum
ENINNFNEVFFFLKLWLSSFNIGKSIHCKK

SEQ ID NO: 3396871 - protein, 23 aa, Plasmodium falciparum
ENKEYVIKLFFGNLAPITTEKDM

SEQ ID NO: 3396872 - protein, 23 aa, Plasmodium falciparum
ENKKFRILCFQKGSGRLFLNTDI

SEQ ID NO: 3396873 - protein, 24 aa, Plasmodium falciparum
ENKNIYFNLFFGKKSKKNNNNNNN

SEQ ID NO: 3396874 - protein, 27 aa, Plasmodium falciparum
ENKSSFSMLYLFGKVKFYISIIDIIHN

SEQ ID NO: 3396875 - protein, 23 aa, Plasmodium falciparum
ENMKTLLYIIPSKKIYKSLNSNW

SEQ ID NO: 3396876 - protein, 17 aa, Plasmodium falciparum
ENNILCNLLYKMKWKNI

SEQ ID NO: 3396877 - protein, 28 aa, Plasmodium falciparum
ENRKKYTAFLPYLKHFYPNRLKDLIEQL

SEQ ID NO: 3396878 - protein, 17 aa, Plasmodium falciparum
ENVFEKYWFFFENNKIE

SEQ ID NO: 3396879 - protein, 21 aa, Plasmodium falciparum
ENYILYCMFYEFAEDIIRIKL

SEQ ID NO: 3396880 - protein, 19 aa, Plasmodium falciparum
EPFFFSIQLPNMLPALLSK

SEQ ID NO: 3396881 - protein, 25 aa, Plasmodium falciparum
EPNFPYWCLGKYLPFVLVLETLNFE

SEQ ID NO: 3396882 - protein, 18 aa, Plasmodium falciparum
EQEMLLRSLLFFYFKKKF

SEQ ID NO: 3396883 - protein, 27 aa, Plasmodium falciparum
EQKLVINFNLFPFKFIDLLEECILEND

SEQ ID NO: 3396884 - protein, 19 aa, Plasmodium falciparum
EQYNWFISTLNLRKVYIYE

SEQ ID NO: 3396885 - protein, 29 aa, Plasmodium falciparum
ERINYMFVCPFIPNLIKWINVLKLSIKGK

SEQ ID NO: 3396886 - protein, 18 aa, Plasmodium falciparum
ERLYREKIYTKIDLLEIY

SEQ ID NO: 3396887 - protein, 20 aa, Plasmodium falciparum
ERTYIYIHKVYILKCLIRKE

SEQ ID NO: 3396888 - protein, 23 aa, Plasmodium falciparum
ESEAFFYAWLYLSCLKKINISRT

SEQ ID NO: 3396889 - protein, 25 aa, Plasmodium falciparum
ESHVPFYVVISIFMLSLPQKLQNDD

SEQ ID NO: 3396890 - protein, 21 aa, Plasmodium falciparum
ESIALMYWLLAQEVLYLKGVI

SEQ ID NO: 3396891 - protein, 25 aa, Plasmodium falciparum
ESKKYIFITLSRYFLLVKNAILSSP

SEQ ID NO: 3396892 - protein, 24 aa, Plasmodium falciparum
ESKYIFKYFFLFEHPHHIHFKDKI

SEQ ID NO: 3396893 - protein, 22 aa, Plasmodium falciparum
ESKYQLLFLRKGNDYKNIFFLE

SEQ ID NO: 3396894 - protein, 24 aa, Plasmodium falciparum
ESVCNYFVFIYYTSKMKAPVLEDN

SEQ ID NO: 3396895 - protein, 20 aa, Plasmodium falciparum
ETFYFIFTFFMEPHFIWEEL

SEQ ID NO: 3396896 - protein, 25 aa, Plasmodium falciparum
ETIFNVYWHLLNNEKYKYIQNIILF

SEQ ID NO: 3396897 - protein, 19 aa, Plasmodium falciparum
ETLFYIFYNLPRDVLQAYA

SEQ ID NO: 3396898 - protein, 20 aa, Plasmodium falciparum
EVFFYLLILLYLLDEKCYDE

SEQ ID NO: 3396899 - protein, 21 aa, Plasmodium falciparum
EVFYYAKLMFPYLKDEIKENI

SEQ ID NO: 3396900 - protein, 27 aa, Plasmodium falciparum
EVKLFIKKIPIYIWVKQFNLMNEYDGE

SEQ ID NO: 3396901 - protein, 22 aa, Plasmodium falciparum
EVNLLVYRYLVENGFVHTSFSF

SEQ ID NO: 3396902 - protein, 22 aa, Plasmodium falciparum
EVVDNLTSEKNKESLKKDKRKK

SEQ ID NO: 3396903 - protein, 18 aa, Plasmodium falciparum
EWFLKCIALIQHNIRKWL

SEQ ID NO: 3396904 - protein, 27 aa, Plasmodium falciparum
EYCIEAFLQLIYSTGFFIDKIEKYKNV

SEQ ID NO: 3396905 - protein, 21 aa, Plasmodium falciparum
EYNILPYYFLTKLNDKYFKNI

SEQ ID NO: 3396906 - protein, 22 aa, Plasmodium falciparum
EYSNIFLLKYDSIKYVKKNINY

SEQ ID NO: 3396907 - protein, 18 aa, Plasmodium falciparum
FAVKVLRYFWPNFKYKFG

SEQ ID NO: 3396908 - protein, 17 aa, Plasmodium falciparum
FCCHLVNLPLYKKRSHL

SEQ ID NO: 3396909 - protein, 17 aa, Plasmodium falciparum
FCCSRYFSSNFPFEKTM

SEQ ID NO: 3396910 - protein, 18 aa, Plasmodium falciparum
FCLYLEKLSLVKDGLHQY

SEQ ID NO: 3396911 - protein, 25 aa, Plasmodium falciparum
FCSYKNLFYLCTRKRLYFLKLFYVK

SEQ ID NO: 3396912 - protein, 28 aa, Plasmodium falciparum
FDDKKWLHLYKIWKLIPLTLKFKAINSR

SEQ ID NO: 3396913 - protein, 25 aa, Plasmodium falciparum
FDENNFSLPYFIFVLRDVNKEEFSK

SEQ ID NO: 3396914 - protein, 18 aa, Plasmodium falciparum
FDFFSKDPLIIFYPNNLE

SEQ ID NO: 3396915 - protein, 20 aa, Plasmodium falciparum
FDKIIFFKMGRFYEIFYIDA

SEQ ID NO: 3396916 - protein, 25 aa, Plasmodium falciparum
FDKTLFLFYNVLLKVSVHISGLYNT

SEQ ID NO: 3396917 - protein, 19 aa, Plasmodium falciparum
FDLLDFFNLYNWPMHNNKN

SEQ ID NO: 3396918 - protein, 24 aa, Plasmodium falciparum
FEELKELFLFFFPEQVMSIDENII

SEQ ID NO: 3396919 - protein, 19 aa, Plasmodium falciparum
FEEPFQLLFLMGFTIYATE

SEQ ID NO: 3396920 - protein, 26 aa, Plasmodium falciparum
FENNNFCPIFLKLLKIDIYNTCYTVD

SEQ ID NO: 3396921 - protein, 18 aa, Plasmodium falciparum
FFFVKYIYMKLFDVYSKN

SEQ ID NO: 3396922 - protein, 17 aa, Plasmodium falciparum
FFIFFKFKESFIRDYLI

SEQ ID NO: 3396923 - protein, 28 aa, Plasmodium falciparum
FFNDFMLFRNMYQQIFNPSFRAADAEVH

SEQ ID NO: 3396924 - protein, 18 aa, Plasmodium falciparum
FFYQSLISDILFIAKSHI

SEQ ID NO: 3396925 - protein, 24 aa, Plasmodium falciparum
FGIVTKMRFLTFPQYYAIKKISKD

SEQ ID NO: 3396926 - protein, 17 aa, Plasmodium falciparum
FHILYIFWDILYNLRNV

SEQ ID NO: 3396927 - protein, 18 aa, Plasmodium falciparum
FHNLLLNLKFFFPSLKNL

SEQ ID NO: 3396928 - protein, 19 aa, Plasmodium falciparum
FIEYILPLFLLFIRIEETN

SEQ ID NO: 3396929 - protein, 24 aa, Plasmodium falciparum
FIGKKYVLLYFYPLDFTFVCPSEI

SEQ ID NO: 3396930 - protein, 18 aa, Plasmodium falciparum
FIIYHTLPHNISLRKQLF

SEQ ID NO: 3396931 - protein, 24 aa, Plasmodium falciparum
FIKKSLCLILIELLKPQVQNILSD

SEQ ID NO: 3396932 - protein, 26 aa, Plasmodium falciparum
FIVYEQFPLFTSFYYTITSLISLDNI

SEQ ID NO: 3396933 - protein, 24 aa, Plasmodium falciparum
FKLDMNILCYFVTAGINPPVSFDE

SEQ ID NO: 3396934 - protein, 21 aa, Plasmodium falciparum
FKYGFPYFWINALVEKPYSLS

SEQ ID NO: 3396935 - protein, 19 aa, Plasmodium falciparum
FKYIYFKYINKDKNNFYPV

SEQ ID NO: 3396936 - protein, 24 aa, Plasmodium falciparum
FLEIDIKLLRWLTTIMIKTSNSLN

SEQ ID NO: 3396937 - protein, 20 aa, Plasmodium falciparum
FLFILLNLYINENNFIRNEL

SEQ ID NO: 3396938 - protein, 23 aa, Plasmodium falciparum
FLHVTDFLYHLILHIYTKFTEKN

SEQ ID NO: 3396939 - protein, 17 aa, Plasmodium falciparum
FLKKFVFFQYITNKYES

SEQ ID NO: 3396940 - protein, 19 aa, Plasmodium falciparum
FLKYLYLCTLKKKIQAHYN

SEQ ID NO: 3396941 - protein, 21 aa, Plasmodium falciparum
FLNTDIFDGFKIIPSKNLSAL

SEQ ID NO: 3396942 - protein, 18 aa, Plasmodium falciparum
FLSVFNFNSLILANTITD

SEQ ID NO: 3396943 - protein, 18 aa, Plasmodium falciparum
FLVLYYFIVLEDNFLKIF

SEQ ID NO: 3396944 - protein, 17 aa, Plasmodium falciparum
FMDNFLSLIDKKINIKN

SEQ ID NO: 3396945 - protein, 18 aa, Plasmodium falciparum
FMYNTCGVPFLFNQRFQN

SEQ ID NO: 3396946 - protein, 19 aa, Plasmodium falciparum
FNEKLHAHILKHTLKKYAC

SEQ ID NO: 3396947 - protein, 17 aa, Plasmodium falciparum
FNMLYYKMKDYGKVLCL

SEQ ID NO: 3396948 - protein, 20 aa, Plasmodium falciparum
FNMNDIFYPFTIKNFNLCKN

SEQ ID NO: 3396949 - protein, 20 aa, Plasmodium falciparum
FNNVYRLLYIWMKLIEIKDT

SEQ ID NO: 3396950 - protein, 17 aa, Plasmodium falciparum
FPKILWKSKAGGVCVPQ

SEQ ID NO: 3396951 - protein, 17 aa, Plasmodium falciparum
FPLKYLCPYFLSKLKYH

SEQ ID NO: 3396952 - protein, 17 aa, Plasmodium falciparum
FPYLIVTLRSLVRVIKP

SEQ ID NO: 3396953 - protein, 17 aa, Plasmodium falciparum
FQYIYLLKYASNEKEST

SEQ ID NO: 3396954 - protein, 19 aa, Plasmodium falciparum
FRINTIYPLLKWKINHIND

SEQ ID NO: 3396955 - protein, 22 aa, Plasmodium falciparum
FRLLKLLGEWIKYGLVLIFVNK

SEQ ID NO: 3396956 - protein, 20 aa, Plasmodium falciparum
FRSKWYIHFYKICLYNEKIY

SEQ ID NO: 3396957 - protein, 19 aa, Plasmodium falciparum
FRVYLVPHILIYALTKYSV

SEQ ID NO: 3396958 - protein, 17 aa, Plasmodium falciparum
FSFSFLEPFYMSNVLIK

SEQ ID NO: 3396959 - protein, 23 aa, Plasmodium falciparum
FSHTFYIFLSYDYKKKLSIKNFK

SEQ ID NO: 3396960 - protein, 25 aa, Plasmodium falciparum
FTILKKYLYIIKNKKMIFIKKKRYT

SEQ ID NO: 3396961 - protein, 19 aa, Plasmodium falciparum
FTLDKFFCLFSLLKIKNKI

SEQ ID NO: 3396962 - protein, 17 aa, Plasmodium falciparum
FVAKYDYIFKKLSYYIT

SEQ ID NO: 3396963 - protein, 18 aa, Plasmodium falciparum
FVDPSEFFVFFNISYKLI

SEQ ID NO: 3396964 - protein, 17 aa, Plasmodium falciparum
FVHVILYPDAFKIDSHK

SEQ ID NO: 3396965 - protein, 19 aa, Plasmodium falciparum
FVKISLFLFFFVHKNFIYS

SEQ ID NO: 3396966 - protein, 24 aa, Plasmodium falciparum
FYFLREFIIFIKKIKKLKTLFIKN

SEQ ID NO: 3396967 - protein, 18 aa, Plasmodium falciparum
FYILLKENIFLFLFDFIK

SEQ ID NO: 3396968 - protein, 21 aa, Plasmodium falciparum
FYILYLYIYKRNLVQNENVNK

SEQ ID NO: 3396969 - protein, 18 aa, Plasmodium falciparum
FYKIIFQDLFSLLNEFIM

SEQ ID NO: 3396970 - protein, 17 aa, Plasmodium falciparum
FYKYMMYCYIKGNLISY

SEQ ID NO: 3396971 - protein, 26 aa, Plasmodium falciparum
FYNYYFDDYFYFFIKSCYDLDLYIKI

SEQ ID NO: 3396972 - protein, 19 aa, Plasmodium falciparum
GAKCPRWASINLGIIICIE

SEQ ID NO: 3396973 - protein, 20 aa, Plasmodium falciparum
GAKCPRWASINLGIIICIEC

SEQ ID NO: 3396974 - protein, 26 aa, Plasmodium falciparum
GALVSFLQKALIFIYIEYHTDHNDGK

SEQ ID NO: 3396975 - protein, 21 aa, Plasmodium falciparum
GDIMHMQWKKRFAFIEYYKAS

SEQ ID NO: 3396976 - protein, 24 aa, Plasmodium falciparum
GDYKCNFFFHWKKIMELNNEELKI

SEQ ID NO: 3396977 - protein, 44 aa, Plasmodium falciparum
GEAELYKFYLPQYNFFYYLKFRPYVRQFLQILSLYYELAIYTNA

SEQ ID NO: 3396978 - protein, 23 aa, Plasmodium falciparum
GECGCPFFYIKLPEYIKYISNDN

SEQ ID NO: 3396979 - protein, 18 aa, Plasmodium falciparum
GEWIKYGLVLIFVNKQIE

SEQ ID NO: 3396980 - protein, 18 aa, Plasmodium falciparum
GFVKYFYYFNNMSDFYYI

SEQ ID NO: 3396981 - protein, 23 aa, Plasmodium falciparum
GHPEYLPRIPGVRFNPKKQQWLA

SEQ ID NO: 3396982 - protein, 25 aa, Plasmodium falciparum
GHPQSSILKILWFGYVDICKCILKN

SEQ ID NO: 3396983 - protein, 17 aa, Plasmodium falciparum
GIRSPWRMVRSRYYVTS

SEQ ID NO: 3396984 - protein, 18 aa, Plasmodium falciparum
GIVKFWFLDKYMYKLLFT

SEQ ID NO: 3396985 - protein, 25 aa, Plasmodium falciparum
GKHMVGFTCFLKRGTQNPVPPPPAP

SEQ ID NO: 3396986 - protein, 19 aa, Plasmodium falciparum
GKIPLLHKVLKPLPAKNRS

SEQ ID NO: 3396987 - protein, 28 aa, Plasmodium falciparum
GKRSTGGVFFYLIKYMYKNDIISKFKYD

SEQ ID NO: 3396988 - protein, 25 aa, Plasmodium falciparum
GKRVAKYFPIKLFGFDYARRLAIYC

SEQ ID NO: 3396989 - protein, 17 aa, Plasmodium falciparum
GKSQKIDILIKPNLKKG

SEQ ID NO: 3396990 - protein, 24 aa, Plasmodium falciparum
GLNNYQVNLLFKNFKRLAPNQRKA

SEQ ID NO: 3396991 - protein, 24 aa, Plasmodium falciparum
GLTYFYFKLFLNNIGKFFYPELTE

SEQ ID NO: 3396992 - protein, 18 aa, Plasmodium falciparum
GQEFLPFLFLRLATQIDY

SEQ ID NO: 3396993 - protein, 25 aa, Plasmodium falciparum
GQFVIPLYMRSPKPEQIPIPLYFSE

SEQ ID NO: 3396994 - protein, 22 aa, Plasmodium falciparum
GQTKYWQFIKLTNKIYLIDCPG

SEQ ID NO: 3396995 - protein, 24 aa, Plasmodium falciparum
GRCINRYFPVYKFGFEEARRLAIQ

SEQ ID NO: 3396996 - protein, 24 aa, Plasmodium falciparum
GSKVKLLCKCGFKNFLKKNNNWVR

SEQ ID NO: 3396997 - protein, 23 aa, Plasmodium falciparum
GVEWLLKSFLTGGAILADEMGLG

SEQ ID NO: 3396998 - protein, 24 aa, Plasmodium falciparum
GVSSLIPYLKLFSTEILNNVLPSA

SEQ ID NO: 3396999 - protein, 19 aa, Plasmodium falciparum
GYNVIHISYIDWRKLRNKS

SEQ ID NO: 3397000 - protein, 21 aa, Plasmodium falciparum
GYRPFIYSWLQKLKDINTYGM

SEQ ID NO: 3397001 - protein, 36 aa, Plasmodium falciparum
GYYANYCYPNYYYPIYYYPNYYYPNNYYAYNNFPHN

SEQ ID NO: 3397002 - protein, 18 aa, Plasmodium falciparum
HAHILKHTLKKYACNKNV

SEQ ID NO: 3397003 - protein, 25 aa, Plasmodium falciparum
HENARLFALFELIKYNCVPDSLKEE

SEQ ID NO: 3397004 - protein, 28 aa, Plasmodium falciparum
HGPKHIYHDLLYLYFKKLPDKKNDGTYD

SEQ ID NO: 3397005 - protein, 17 aa, Plasmodium falciparum
HILILFQARPMLEFYKP

SEQ ID NO: 3397006 - protein, 19 aa, Plasmodium falciparum
HIPLFLYPFLNAESKNRPF

SEQ ID NO: 3397007 - protein, 23 aa, Plasmodium falciparum
HIQNIQWVQLLPLSYIKGNHINF

SEQ ID NO: 3397008 - protein, 23 aa, Plasmodium falciparum
HITFKHIIKTPLYLYKSKEDKNK

SEQ ID NO: 3397009 - protein, 25 aa, Plasmodium falciparum
HIYNYNFFFLFYNFHLFLLSTQPIK

SEQ ID NO: 3397010 - protein, 18 aa, Plasmodium falciparum
HLAKLFPTQWRTIAPIVG

SEQ ID NO: 3397011 - protein, 25 aa, Plasmodium falciparum
HLDFKKAYFFIFKDDIYIYGARNNQ

SEQ ID NO: 3397012 - protein, 18 aa, Plasmodium falciparum
HMFPLLPSSPFFQPPNFR

SEQ ID NO: 3397013 - protein, 19 aa, Plasmodium falciparum
HMPQYIIKAPWYLNQTKPG

SEQ ID NO: 3397014 - protein, 17 aa, Plasmodium falciparum
HNNLYYYKGKKIKMKNI

SEQ ID NO: 3397015 - protein, 25 aa, Plasmodium falciparum
HNQSVPLRFYLIKNILPILTDALIY

SEQ ID NO: 3397016 - protein, 23 aa, Plasmodium falciparum
HNTSWFCMIFDFDGISKLLNVFN

SEQ ID NO: 3397017 - protein, 17 aa, Plasmodium falciparum
HRLFKFPCCNKIFPCPT

SEQ ID NO: 3397018 - protein, 17 aa, Plasmodium falciparum
HSLFFLKYFLLIPEEQV

SEQ ID NO: 3397019 - protein, 23 aa, Plasmodium falciparum
HSRLMELFLFISTLRRSSAKKVT

SEQ ID NO: 3397020 - protein, 25 aa, Plasmodium falciparum
HTKKEMMYNFYSEKAILLVSFNDES

SEQ ID NO: 3397021 - protein, 17 aa, Plasmodium falciparum
HVFFLIISTKPFLGPVL

SEQ ID NO: 3397022 - protein, 17 aa, Plasmodium falciparum
HWIMFQLYTILFEGYRD

SEQ ID NO: 3397023 - protein, 20 aa, Plasmodium falciparum
HYIQYPILLLFKNTEKIKKN

SEQ ID NO: 3397024 - protein, 23 aa, Plasmodium falciparum
IADKGLHIFVIPVLRHILEERGY

SEQ ID NO: 3397025 - protein, 23 aa, Plasmodium falciparum
ICNKAWKILYKYFPFVINNELNN

SEQ ID NO: 3397026 - protein, 24 aa, Plasmodium falciparum
ICTNKYMWRFLQFLYNGGPCIKRI

SEQ ID NO: 3397027 - protein, 23 aa, Plasmodium falciparum
IDDILNFIYLFLEYFQILKKELH

SEQ ID NO: 3397028 - protein, 18 aa, Plasmodium falciparum
IDIFPRQCYLILCSYKYM

SEQ ID NO: 3397029 - protein, 24 aa, Plasmodium falciparum
IDLYNIFIFYIFIHNLFPCCICSI

SEQ ID NO: 3397030 - protein, 26 aa, Plasmodium falciparum
IDNILHNLIILFYEFYYYNQMDNFKI

SEQ ID NO: 3397031 - protein, 18 aa, Plasmodium falciparum
IDQSIINKLLYLKKSFDF

SEQ ID NO: 3397032 - protein, 18 aa, Plasmodium falciparum
IEELKNLVLFLNNENKRL

SEQ ID NO: 3397033 - protein, 19 aa, Plasmodium falciparum
IEYYIALLKFVLFKLYKLD

SEQ ID NO: 3397034 - protein, 19 aa, Plasmodium falciparum
IFDILPLLNIYFNFFYIYG

SEQ ID NO: 3397035 - protein, 19 aa, Plasmodium falciparum
IFFIYLIYVRSHFSQPTSS

SEQ ID NO: 3397036 - protein, 20 aa, Plasmodium falciparum
IFFVKFMLYYIYKKEYVHAN

SEQ ID NO: 3397037 - protein, 18 aa, Plasmodium falciparum
IFLNFYLNALYQKLCNYF

SEQ ID NO: 3397038 - protein, 22 aa, Plasmodium falciparum
IFNKLFIFYLDKIQILSFLKEN

SEQ ID NO: 3397039 - protein, 19 aa, Plasmodium falciparum
IFSCNLKFPDFVNPLAIDL

SEQ ID NO: 3397040 - protein, 18 aa, Plasmodium falciparum
IFSKLPFFYLFYPSSYKK

SEQ ID NO: 3397041 - protein, 18 aa, Plasmodium falciparum
IFYNIFFLKLLGIQNICS

SEQ ID NO: 3397042 - protein, 23 aa, Plasmodium falciparum
IGDINNVVLLKTSLNYKGIINAD

SEQ ID NO: 3397043 - protein, 27 aa, Plasmodium falciparum
IGIVFKKWKFKNFGLYFWYHIKCIENE

SEQ ID NO: 3397044 - protein, 26 aa, Plasmodium falciparum
IGKNFQMRRFPIKKLGFEKAKELAIQ

SEQ ID NO: 3397045 - protein, 24 aa, Plasmodium falciparum
IHDYIYLLLLPPISYHPLAYELIL

SEQ ID NO: 3397046 - protein, 22 aa, Plasmodium falciparum
IHEGFDIFPMEGFKFRSIVIDG

SEQ ID NO: 3397047 - protein, 18 aa, Plasmodium falciparum
IHIEYKWSIDKWSYAFVY

SEQ ID NO: 3397048 - protein, 23 aa, Plasmodium falciparum
IHKKYIIYQLLRALKYIHSGGLL

SEQ ID NO: 3397049 - protein, 37 aa, Plasmodium falciparum
IHKNVWKRMYIPEEIKFFILKYITLLNNLRDYIISVH

SEQ ID NO: 3397050 - protein, 20 aa, Plasmodium falciparum
IIELIKYISYMQKALIKASE

SEQ ID NO: 3397051 - protein, 23 aa, Plasmodium falciparum
IIEPIIENTWLKKVLLIIKKESL

SEQ ID NO: 3397052 - protein, 26 aa, Plasmodium falciparum
IIFKAYYLRGIARYKLRIYKLSLKDF

SEQ ID NO: 3397053 - protein, 17 aa, Plasmodium falciparum
IIHIFDKIISKMKKEIN

SEQ ID NO: 3397054 - protein, 24 aa, Plasmodium falciparum
IIHSYFDIWLVTKLVNGLDLHTIK

SEQ ID NO: 3397055 - protein, 19 aa, Plasmodium falciparum
IIIRILFLSFLRYSISNNN

SEQ ID NO: 3397056 - protein, 18 aa, Plasmodium falciparum
IIISIIYKQNFWYNNILN

SEQ ID NO: 3397057 - protein, 20 aa, Plasmodium falciparum
IIKILLPPLYFFNEAKRKKK

SEQ ID NO: 3397058 - protein, 26 aa, Plasmodium falciparum
IIKNEKMMFYFLYNTKDVLNNIIYME

SEQ ID NO: 3397059 - protein, 18 aa, Plasmodium falciparum
IILLFLPKNVQSYEERLF

SEQ ID NO: 3397060 - protein, 38 aa, Plasmodium falciparum
IILLNFFISNNCQWSFSLFPLSLINKLIHKFSLKINKK

SEQ ID NO: 3397061 - protein, 23 aa, Plasmodium falciparum
IINKYLINPIYNLFLRANEEIQN

SEQ ID NO: 3397062 - protein, 26 aa, Plasmodium falciparum
IINYIKLILRYIYKVLKLAFQKLKSD

SEQ ID NO: 3397063 - protein, 18 aa, Plasmodium falciparum
IIQFIRNNIYINSYIYDC

SEQ ID NO: 3397064 - protein, 20 aa, Plasmodium falciparum
IIQRILFRLDILDKLFILKN

SEQ ID NO: 3397065 - protein, 18 aa, Plasmodium falciparum
IIQYNKFPLFKRTKSSIL

SEQ ID NO: 3397066 - protein, 24 aa, Plasmodium falciparum
IIRKNWIMYITKYDYKYLLKCIIK

SEQ ID NO: 3397067 - protein, 24 aa, Plasmodium falciparum
IIRWNLPRPYFLDKINLFNNYMHN

SEQ ID NO: 3397068 - protein, 17 aa, Plasmodium falciparum
IISLFYLNLETYEIFCV

SEQ ID NO: 3397069 - protein, 21 aa, Plasmodium falciparum
IIYLEHDLIYLKKNNLKVILN

SEQ ID NO: 3397070 - protein, 17 aa, Plasmodium falciparum
IIYYFLFYKNSYEYNIY

SEQ ID NO: 3397071 - protein, 23 aa, Plasmodium falciparum
IKCLYFFFLINILRFKNNLDLNV

SEQ ID NO: 3397072 - protein, 19 aa, Plasmodium falciparum
IKECLLIIDILYILNNTYG

SEQ ID NO: 3397073 - protein, 23 aa, Plasmodium falciparum
IKHHYFFFFLQISDYLKYFYILS

SEQ ID NO: 3397074 - protein, 21 aa, Plasmodium falciparum
IKINLTFPIFFIICKSDGYEI

SEQ ID NO: 3397075 - protein, 18 aa, Plasmodium falciparum
IKIRTNSFIFYLSKELNK

SEQ ID NO: 3397076 - protein, 24 aa, Plasmodium falciparum
IKKDILYSIIYPYKFRLSNLNCII

SEQ ID NO: 3397077 - protein, 23 aa, Plasmodium falciparum
IKKLLYQYFLFFKNIFDNTCLTY

SEQ ID NO: 3397078 - protein, 28 aa, Plasmodium falciparum
IKKNHGYLHFMWLKRKTLCIEIIKCIAT

SEQ ID NO: 3397079 - protein, 21 aa, Plasmodium falciparum
IKKYFDFCVIKLCKPTLIKGI

SEQ ID NO: 3397080 - protein, 23 aa, Plasmodium falciparum
IKKYKKLLKLIKKVILLSVENGN

SEQ ID NO: 3397081 - protein, 18 aa, Plasmodium falciparum
IKLLKKRKIILLKAPIFT

SEQ ID NO: 3397082 - protein, 21 aa, Plasmodium falciparum
IKLYCIEILKALNYLRKMSLT

SEQ ID NO: 3397083 - protein, 23 aa, Plasmodium falciparum
IKNLIPLYRYIPLILQKLNTEYL

SEQ ID NO: 3397084 - protein, 22 aa, Plasmodium falciparum
IKPDLIFLFDEAWFAYACFHPI

SEQ ID NO: 3397085 - protein, 26 aa, Plasmodium falciparum
IKPWLRGIIWEDKLKKWIVFFKDKNE

SEQ ID NO: 3397086 - protein, 20 aa, Plasmodium falciparum
IKPYFLNIYVFTCFINFCIH

SEQ ID NO: 3397087 - protein, 23 aa, Plasmodium falciparum
IKQKFRLLYSFGPQIRYLHSDEY

SEQ ID NO: 3397088 - protein, 18 aa, Plasmodium falciparum
ILCLIKLIEKYKLDPHSL

SEQ ID NO: 3397089 - protein, 18 aa, Plasmodium falciparum
ILDYIKYIKYIKLGGKIS

SEQ ID NO: 3397090 - protein, 23 aa, Plasmodium falciparum
ILHNLIYGYIYKGDNVRLTIGKE

SEQ ID NO: 3397091 - protein, 19 aa, Plasmodium falciparum
ILIDAWFKYSFYTKWMNKF

SEQ ID NO: 3397092 - protein, 17 aa, Plasmodium falciparum
ILKNFFPLYKFKVLGRT

SEQ ID NO: 3397093 - protein, 23 aa, Plasmodium falciparum
ILLPLMVRFIFLSATIPNGIQFA

SEQ ID NO: 3397094 - protein, 25 aa, Plasmodium falciparum
ILQNEKFPFIFYDSNLRNLVIYYKD

SEQ ID NO: 3397095 - protein, 19 aa, Plasmodium falciparum
ILREYLLKDLFFDTSFNME

SEQ ID NO: 3397096 - protein, 20 aa, Plasmodium falciparum
ILYQCLKLLIRLHDAGLSHL

SEQ ID NO: 3397097 - protein, 24 aa, Plasmodium falciparum
IMKGYIKNFWYLSKKIFFGKYKNC

SEQ ID NO: 3397098 - protein, 23 aa, Plasmodium falciparum
IMKKKKLLLLIEKAKLQNFTYKN

SEQ ID NO: 3397099 - protein, 21 aa, Plasmodium falciparum
IMRFLIKNLLFFNIYNKKIYY

SEQ ID NO: 3397100 - protein, 23 aa, Plasmodium falciparum
INAPIDLVLLTKKLKRLPVVNFA

SEQ ID NO: 3397101 - protein, 26 aa, Plasmodium falciparum
INDQKVKFFNDNFLKFLKQITNHNIN

SEQ ID NO: 3397102 - protein, 19 aa, Plasmodium falciparum
INFLFENIIFFIKFLTNIQ

SEQ ID NO: 3397103 - protein, 24 aa, Plasmodium falciparum
INFRNLIIDTLYLFKYIFNNKEFS

SEQ ID NO: 3397104 - protein, 22 aa, Plasmodium falciparum
INHYIYLLRLLPKFSLPLYDSG

SEQ ID NO: 3397105 - protein, 20 aa, Plasmodium falciparum
INIFLKYLKMIDVNSLSHLF

SEQ ID NO: 3397106 - protein, 21 aa, Plasmodium falciparum
INIIFMHKYIYLKNLKKRNYF

SEQ ID NO: 3397107 - protein, 22 aa, Plasmodium falciparum
INIMSYYYNHILYRLRMKNKYE

SEQ ID NO: 3397108 - protein, 17 aa, Plasmodium falciparum
INKFSLHFFLKNNNYLN

SEQ ID NO: 3397109 - protein, 24 aa, Plasmodium falciparum
INLKKYKLMWLLNVNKTYLNYNEI

SEQ ID NO: 3397110 - protein, 25 aa, Plasmodium falciparum
INLKQLYLFIFFNIYKYFKYISTPG

SEQ ID NO: 3397111 - protein, 25 aa, Plasmodium falciparum
INMDSLIQTILLASSLIINTSARAV

SEQ ID NO: 3397112 - protein, 17 aa, Plasmodium falciparum
INNFLLNQHFNFNKNDN

SEQ ID NO: 3397113 - protein, 18 aa, Plasmodium falciparum
INNIKNSMLLLNDIKRIV

SEQ ID NO: 3397114 - protein, 24 aa, Plasmodium falciparum
INNPNYVMVLLFLTVYKDVLKMNW

SEQ ID NO: 3397115 - protein, 21 aa, Plasmodium falciparum
INNRFFIIILIPLNTPIKTDC

SEQ ID NO: 3397116 - protein, 22 aa, Plasmodium falciparum
INNVYIYMLLNYKYLHNYHTKN

SEQ ID NO: 3397117 - protein, 20 aa, Plasmodium falciparum
INPYNFLSCSLPTPPPQLPH

SEQ ID NO: 3397118 - protein, 25 aa, Plasmodium falciparum
INTENLFFHLYFLSELYKEKRYICQ

SEQ ID NO: 3397119 - protein, 17 aa, Plasmodium falciparum
INTYLIQYPLRPKYRPY

SEQ ID NO: 3397120 - protein, 26 aa, Plasmodium falciparum
INYYYYYYYYYYYYYHYHYGGKYSLE

SEQ ID NO: 3397121 - protein, 26 aa, Plasmodium falciparum
IPFKFKYFFIPLSRYVAYFFPTFRPS

SEQ ID NO: 3397122 - protein, 18 aa, Plasmodium falciparum
IPFVRRATRTLTFKNQGG

SEQ ID NO: 3397123 - protein, 25 aa, Plasmodium falciparum
IQHNFVPLYFNNGLFKYVYNFSQVE

SEQ ID NO: 3397124 - protein, 24 aa, Plasmodium falciparum
IQIRKPVFFNIRRNKFIALQIGRT

SEQ ID NO: 3397125 - protein, 23 aa, Plasmodium falciparum
IQKINKFYYYFKEFLLKEKYNTK

SEQ ID NO: 3397126 - protein, 26 aa, Plasmodium falciparum
IQNIILFLDSNLYTRAVWLLKKGYNM

SEQ ID NO: 3397127 - protein, 17 aa, Plasmodium falciparum
IQNLLKLIGLLKAQINQ

SEQ ID NO: 3397128 - protein, 18 aa, Plasmodium falciparum
IQRIKYTGPTILDKINRE

SEQ ID NO: 3397129 - protein, 18 aa, Plasmodium falciparum
IQRKNEFIFLWPKTFHGG

SEQ ID NO: 3397130 - protein, 25 aa, Plasmodium falciparum
IRCCAIFLNFLLFYDKINLSIDIVK

SEQ ID NO: 3397131 - protein, 20 aa, Plasmodium falciparum
IRLCLNYDPNLRPTASEIVQ

SEQ ID NO: 3397132 - protein, 24 aa, Plasmodium falciparum
IRYKKLPLYLEWAPLNLFAKQKDI

SEQ ID NO: 3397133 - protein, 26 aa, Plasmodium falciparum
ISNKLLISATKFLKYFFPLLKVNVKE

SEQ ID NO: 3397134 - protein, 22 aa, Plasmodium falciparum
ISNNLFFLFEYYYNYLVNMIKN

SEQ ID NO: 3397135 - protein, 19 aa, Plasmodium falciparum
ISTYSIFMYILRSHFFKHI

SEQ ID NO: 3397136 - protein, 24 aa, Plasmodium falciparum
ITKLDEIIGLMKLVFEKAVTQHHF

SEQ ID NO: 3397137 - protein, 23 aa, Plasmodium falciparum
ITKLKQHIVFYKNELRVLKELNA

SEQ ID NO: 3397138 - protein, 23 aa, Plasmodium falciparum
IVELRHYRFWSSSLLWVFDGGLS

SEQ ID NO: 3397139 - protein, 17 aa, Plasmodium falciparum
IVFKFIYPKVLPKQNNS

SEQ ID NO: 3397140 - protein, 19 aa, Plasmodium falciparum
IVKYILPSIDDKKLKYSWS

SEQ ID NO: 3397141 - protein, 27 aa, Plasmodium falciparum
IVMLKKLCLRILFINEYQIYNIKKLQE

SEQ ID NO: 3397142 - protein, 25 aa, Plasmodium falciparum
IWSAGVIMFFLFTKSLPFGGNTYDE

SEQ ID NO: 3397143 - protein, 21 aa, Plasmodium falciparum
IWSLGIILYAMLFGLLPYDSE

SEQ ID NO: 3397144 - protein, 19 aa, Plasmodium falciparum
IWTFLFTKIFHSPLFNFTS

SEQ ID NO: 3397145 - protein, 19 aa, Plasmodium falciparum
IYCPKIIILFIPQNIYLQL

SEQ ID NO: 3397146 - protein, 18 aa, Plasmodium falciparum
IYFLYFNLGYEQKALNIC

SEQ ID NO: 3397147 - protein, 19 aa, Plasmodium falciparum
IYFYPYTKLLRRKRLRRIS

SEQ ID NO: 3397148 - protein, 23 aa, Plasmodium falciparum
IYGTIWGFWKYPEKIWEVIRDIS

SEQ ID NO: 3397149 - protein, 17 aa, Plasmodium falciparum
IYHVLALWLMPTSKNTL

SEQ ID NO: 3397150 - protein, 24 aa, Plasmodium falciparum
IYKYALIFSPILKNDGCVSLLSVH

SEQ ID NO: 3397151 - protein, 20 aa, Plasmodium falciparum
IYKYDFFLNKTFKYIYIKYV

SEQ ID NO: 3397152 - protein, 25 aa, Plasmodium falciparum
IYMDYDTWLFNHGKPYANLKPKTYE

SEQ ID NO: 3397153 - protein, 18 aa, Plasmodium falciparum
IYSFYYKFYNILILIKKM

SEQ ID NO: 3397154 - protein, 17 aa, Plasmodium falciparum
IYSLWFYSTEEKEQIYK

SEQ ID NO: 3397155 - protein, 18 aa, Plasmodium falciparum
KADIWSLGIILYAMLFGL

SEQ ID NO: 3397156 - protein, 28 aa, Plasmodium falciparum
KADKYTCMMRKLRGILNKLTFEKFDLLY

SEQ ID NO: 3397157 - protein, 20 aa, Plasmodium falciparum
KANNLFFYLYLTISIHGYNE

SEQ ID NO: 3397158 - protein, 25 aa, Plasmodium falciparum
KCDNYRWLRIIKKSLFIKFFDGTLF

SEQ ID NO: 3397159 - protein, 18 aa, Plasmodium falciparum
KCKKIILLFLPKNVQSYE

SEQ ID NO: 3397160 - protein, 32 aa, Plasmodium falciparum
KCKTKVFFYINPKYIIEPLKRKIYQNMSIYIE

SEQ ID NO: 3397161 - protein, 17 aa, Plasmodium falciparum
KCLLCRKLYTEPVTLHC

SEQ ID NO: 3397162 - protein, 25 aa, Plasmodium falciparum
KCPLDLIPLYILPPYQDLQYLDFIG

SEQ ID NO: 3397163 - protein, 17 aa, Plasmodium falciparum
KCRLKLLKLERIKDYLL

SEQ ID NO: 3397164 - protein, 17 aa, Plasmodium falciparum
KDEKYIHMLMKNFNMYS

SEQ ID NO: 3397165 - protein, 21 aa, Plasmodium falciparum
KDFLLLLLIYYKNKVFLLPQL

SEQ ID NO: 3397166 - protein, 23 aa, Plasmodium falciparum
KDKFRLYRSLLKFGNPSLRLDDI

SEQ ID NO: 3397167 - protein, 20 aa, Plasmodium falciparum
KDLIWLLFDTSLLTSGFALE

SEQ ID NO: 3397168 - protein, 29 aa, Plasmodium falciparum
KDNDNIIIIKFNILKLFKLGSCYLYIINR

SEQ ID NO: 3397169 - protein, 18 aa, Plasmodium falciparum
KDPFNPLLLAYEKKEKKK

SEQ ID NO: 3397170 - protein, 21 aa, Plasmodium falciparum
KDTLLFLLRFNKWKGASYNYT

SEQ ID NO: 3397171 - protein, 24 aa, Plasmodium falciparum
KDYELMFILFYLKYEYRLPLKCEY

SEQ ID NO: 3397172 - protein, 26 aa, Plasmodium falciparum
KDYSNIFPYAYNNLLFYAFDCYKFYR

SEQ ID NO: 3397173 - protein, 22 aa, Plasmodium falciparum
KEDPFTKKWLLQLLYNINNDDE

SEQ ID NO: 3397174 - protein, 24 aa, Plasmodium falciparum
KEDWDYILFLYTSNNKMIYMNNYT

SEQ ID NO: 3397175 - protein, 24 aa, Plasmodium falciparum
KEENKLFYLVPRYNELLQQLDETE

SEQ ID NO: 3397176 - protein, 27 aa, Plasmodium falciparum
KEEVMSLLIWIPYWNHVIPTPAIIKPR

SEQ ID NO: 3397177 - protein, 22 aa, Plasmodium falciparum
KEHIPWAIRNWFWNGSLLYEEL

SEQ ID NO: 3397178 - protein, 17 aa, Plasmodium falciparum
KEKEKIIWFNELKTYLL

SEQ ID NO: 3397179 - protein, 22 aa, Plasmodium falciparum
KEKELFQYLILKAINEIEQIST

SEQ ID NO: 3397180 - protein, 24 aa, Plasmodium falciparum
KEKELIFCFSFIKYYSWIKALQIL

SEQ ID NO: 3397181 - protein, 18 aa, Plasmodium falciparum
KEKIIWFNELKTYLLKNT

SEQ ID NO: 3397182 - protein, 25 aa, Plasmodium falciparum
KEKKKLFLYGYEQQLLYGRINWKLA

SEQ ID NO: 3397183 - protein, 23 aa, Plasmodium falciparum
KEKKSHIILLKEDLHFLNDEYDN

SEQ ID NO: 3397184 - protein, 24 aa, Plasmodium falciparum
KEKLKLIKLITEKLASPLKATSDN

SEQ ID NO: 3397185 - protein, 31 aa, Plasmodium falciparum
KEKLVAQLLIRWWYVLPDWPPPDYDYKDELY

SEQ ID NO: 3397186 - protein, 17 aa, Plasmodium falciparum
KELNNLLYIINIKNKKI

SEQ ID NO: 3397187 - protein, 20 aa, Plasmodium falciparum
KENFIFLHKLKKRNYTKMLQ

SEQ ID NO: 3397188 - protein, 17 aa, Plasmodium falciparum
KEQIMIMKKKNLLLSNR

SEQ ID NO: 3397189 - protein, 25 aa, Plasmodium falciparum
KETMKIFLFLDQKIPFFELSPELKD

SEQ ID NO: 3397190 - protein, 17 aa, Plasmodium falciparum
KEYIYLLLCLLGNKIKI

SEQ ID NO: 3397191 - protein, 19 aa, Plasmodium falciparum
KFCEYIFSKLILYTNYQND

SEQ ID NO: 3397192 - protein, 20 aa, Plasmodium falciparum
KFFCLFSLLKIKNKIYIFLK

SEQ ID NO: 3397193 - protein, 20 aa, Plasmodium falciparum
KFLCNEYFYIPITNTNYFKN

SEQ ID NO: 3397194 - protein, 17 aa, Plasmodium falciparum
KFLDKKFRLSNWLNYSL

SEQ ID NO: 3397195 - protein, 17 aa, Plasmodium falciparum
KFLLLQNRRLKCIIIES

SEQ ID NO: 3397196 - protein, 23 aa, Plasmodium falciparum
KFRKLLFSLFWFHSILNNRKKFD

SEQ ID NO: 3397197 - protein, 21 aa, Plasmodium falciparum
KFVPRHLLYVMSQVASRSFFD

SEQ ID NO: 3397198 - protein, 20 aa, Plasmodium falciparum
KFYFNFPNFVLCNPSFIFSN

SEQ ID NO: 3397199 - protein, 22 aa, Plasmodium falciparum
KGIFNPILLHKATGTRFSRSDK

SEQ ID NO: 3397200 - protein, 22 aa, Plasmodium falciparum
KGILFMELLLYDIKFYHNSSMI

SEQ ID NO: 3397201 - protein, 20 aa, Plasmodium falciparum
KGISHIFVYILPKIFGHLID

SEQ ID NO: 3397202 - protein, 25 aa, Plasmodium falciparum
KGKDKVMIYFLNPGFQKRLLEAYSN

SEQ ID NO: 3397203 - protein, 21 aa, Plasmodium falciparum
KGNLFISFIFLWNKNQMNKIN

SEQ ID NO: 3397204 - protein, 19 aa, Plasmodium falciparum
KGVLLNLFGKPYSLRQRKQ

SEQ ID NO: 3397205 - protein, 23 aa, Plasmodium falciparum
KGVWYNARTKCWLACVKGSGRHL

SEQ ID NO: 3397206 - protein, 20 aa, Plasmodium falciparum
KHESKILPFLLDLNSTNGTY

SEQ ID NO: 3397207 - protein, 20 aa, Plasmodium falciparum
KIAKMFFTLINKTVFQNFLK

SEQ ID NO: 3397208 - protein, 18 aa, Plasmodium falciparum
KICLLNLYFIKMEKPSIY

SEQ ID NO: 3397209 - protein, 17 aa, Plasmodium falciparum
KIDILIKPNLKKGENIW

SEQ ID NO: 3397210 - protein, 18 aa, Plasmodium falciparum
KIFHDVWLPLGTLSAHWY

SEQ ID NO: 3397211 - protein, 24 aa, Plasmodium falciparum
KIFTHLIVCLLPDGGINKLRVYGE

SEQ ID NO: 3397212 - protein, 22 aa, Plasmodium falciparum
KIKFIILYFFCVLFLKDYERSE

SEQ ID NO: 3397213 - protein, 29 aa, Plasmodium falciparum
KIKKYNNIPIFYFRKLFKYIIEQNNNNNN

SEQ ID NO: 3397214 - protein, 23 aa, Plasmodium falciparum
KIKNKIFMITDFGPVLFLGEQDG

SEQ ID NO: 3397215 - protein, 17 aa, Plasmodium falciparum
KIKWPDFLKLNNLIYYN

SEQ ID NO: 3397216 - protein, 23 aa, Plasmodium falciparum
KILPPYMHHFNKAMKIIPEGSSC

SEQ ID NO: 3397217 - protein, 27 aa, Plasmodium falciparum
KIMHPSNITIYLYPTKDYKAHFPNSYM

SEQ ID NO: 3397218 - protein, 18 aa, Plasmodium falciparum
KINFIKKYETIPSLIICG

SEQ ID NO: 3397219 - protein, 22 aa, Plasmodium falciparum
KINYKIIIPFSKLAFYEGEIKY

SEQ ID NO: 3397220 - protein, 25 aa, Plasmodium falciparum
KIQKDCFLFWLIMVKNKKEARNKII

SEQ ID NO: 3397221 - protein, 24 aa, Plasmodium falciparum
KISNIFYMLLFYNSNHFIYNRMKN

SEQ ID NO: 3397222 - protein, 19 aa, Plasmodium falciparum
KITPYLMFTPAKKPMIPVK

SEQ ID NO: 3397223 - protein, 18 aa, Plasmodium falciparum
KIVHLILPQLLNLKIWLE

SEQ ID NO: 3397224 - protein, 27 aa, Plasmodium falciparum
KKAFEKRLYLMWPLIEFSNKYRLDQYF

SEQ ID NO: 3397225 - protein, 27 aa, Plasmodium falciparum
KKAIILRLILMHFLQKGDFFMYYVLNK

SEQ ID NO: 3397226 - protein, 18 aa, Plasmodium falciparum
KKDIIYYFLFYKNSYEYN

SEQ ID NO: 3397227 - protein, 18 aa, Plasmodium falciparum
KKEKKLLYFYLNSLERTV

SEQ ID NO: 3397228 - protein, 22 aa, Plasmodium falciparum
KKFISAYLIYLLQNGNIDDEKM

SEQ ID NO: 3397229 - protein, 20 aa, Plasmodium falciparum
KKFYFFDYLLFYTKAYKQNL

SEQ ID NO: 3397230 - protein, 18 aa, Plasmodium falciparum
KKIMNSFLLFLHMGRNKF

SEQ ID NO: 3397231 - protein, 17 aa, Plasmodium falciparum
KKKDTLLFLLRFNKWKG

SEQ ID NO: 3397232 - protein, 22 aa, Plasmodium falciparum
KKKIRFPIRRIPPNEYYPNIHS

SEQ ID NO: 3397233 - protein, 23 aa, Plasmodium falciparum
KKKKKFFFCSTFLYDNIKSNMFP

SEQ ID NO: 3397234 - protein, 25 aa, Plasmodium falciparum
KKKQQYFHILPFTDFYMNIEISYQI

SEQ ID NO: 3397235 - protein, 26 aa, Plasmodium falciparum
KKKYKKLLIYYLLYNNYLKLSASNIF

SEQ ID NO: 3397236 - protein, 20 aa, Plasmodium falciparum
KKLLFFLYLFSKNYYHLSND

SEQ ID NO: 3397237 - protein, 20 aa, Plasmodium falciparum
KKLLYFYLNSLERTVASLKN

SEQ ID NO: 3397238 - protein, 20 aa, Plasmodium falciparum
KKMIYFIPKRIVLTTVAICI

SEQ ID NO: 3397239 - protein, 25 aa, Plasmodium falciparum
KKNIPLLIILLNFLKNLNINLNHLK

SEQ ID NO: 3397240 - protein, 19 aa, Plasmodium falciparum
KKNIYLYPYLKFIKNELLE

SEQ ID NO: 3397241 - protein, 18 aa, Plasmodium falciparum
KKPMYINKIIFRCKKKKY

SEQ ID NO: 3397242 - protein, 21 aa, Plasmodium falciparum
KKYCIKLLDFLLDALFRNKYF

SEQ ID NO: 3397243 - protein, 20 aa, Plasmodium falciparum
KLFIEIIYNIKFPSLLYTNI

SEQ ID NO: 3397244 - protein, 19 aa, Plasmodium falciparum
KLHFFHFLKKKYKNFYIHI

SEQ ID NO: 3397245 - protein, 17 aa, Plasmodium falciparum
KLILRTGGGFRKLSEHD

SEQ ID NO: 3397246 - protein, 20 aa, Plasmodium falciparum
KLINHFLYLMDNYKLNCIKE

SEQ ID NO: 3397247 - protein, 20 aa, Plasmodium falciparum
KLLNLKKIMNSFLLFLHMGR

SEQ ID NO: 3397248 - protein, 20 aa, Plasmodium falciparum
KLLYNHLYLIKQREAHILRV

SEQ ID NO: 3397249 - protein, 22 aa, Plasmodium falciparum
KLNTLFKILFIPTQVKPHKYYF

SEQ ID NO: 3397250 - protein, 21 aa, Plasmodium falciparum
KLSINFIWLGGLFYPRAFITA

SEQ ID NO: 3397251 - protein, 20 aa, Plasmodium falciparum
KLVMFFLKYITFFVIENREI

SEQ ID NO: 3397252 - protein, 18 aa, Plasmodium falciparum
KLWDLRFLKDSFFTTNIH

SEQ ID NO: 3397253 - protein, 23 aa, Plasmodium falciparum
KMDLQLFFTLLKRKILYSINNSN

SEQ ID NO: 3397254 - protein, 28 aa, Plasmodium falciparum
KNAKLFRLLFQFFFPHISYYFDTNIDET

SEQ ID NO: 3397255 - protein, 21 aa, Plasmodium falciparum
KNDMFLWLKNKDIENVLCEKR

SEQ ID NO: 3397256 - protein, 17 aa, Plasmodium falciparum
KNEPFVLRLPFPASFRG

SEQ ID NO: 3397257 - protein, 25 aa, Plasmodium falciparum
KNEYIFVYRCNICLLLFTCVYTFAE

SEQ ID NO: 3397258 - protein, 24 aa, Plasmodium falciparum
KNGKLYKFYPFYNELLLKYENDPN

SEQ ID NO: 3397259 - protein, 22 aa, Plasmodium falciparum
KNKMNLIHFYDELLQYLMLNNK

SEQ ID NO: 3397260 - protein, 25 aa, Plasmodium falciparum
KNKRIIYIILCKKQIIYILEELYKN

SEQ ID NO: 3397261 - protein, 24 aa, Plasmodium falciparum
KNNKYIFGYFILILANQIKWKVCD

SEQ ID NO: 3397262 - protein, 20 aa, Plasmodium falciparum
KNYLETFPLPKITYLSNDNS

SEQ ID NO: 3397263 - protein, 19 aa, Plasmodium falciparum
KPHKYYFPSVEYFERFYIH

SEQ ID NO: 3397264 - protein, 21 aa, Plasmodium falciparum
KPILYFIPYSYIVPPFSFFKY

SEQ ID NO: 3397265 - protein, 23 aa, Plasmodium falciparum
KPKTYEKFIPLFKFQQNSNQKQN

SEQ ID NO: 3397266 - protein, 23 aa, Plasmodium falciparum
KQKSPIILLPPYITVHELRIMLN

SEQ ID NO: 3397267 - protein, 18 aa, Plasmodium falciparum
KQYKFFMKLPYITVSEML

SEQ ID NO: 3397268 - protein, 17 aa, Plasmodium falciparum
KRELYFLKKFVFFQYIT

SEQ ID NO: 3397269 - protein, 22 aa, Plasmodium falciparum
KRHIIMNMIFLIESFFNNTEKT

SEQ ID NO: 3397270 - protein, 24 aa, Plasmodium falciparum
KRNETYCIFPKKKEIYFNKVNALT

SEQ ID NO: 3397271 - protein, 27 aa, Plasmodium falciparum
KRNITYPYFMFYQINNFLINPNPFHNS

SEQ ID NO: 3397272 - protein, 26 aa, Plasmodium falciparum
KRQYFPVKKFGQAQAKYLAIYARIQA

SEQ ID NO: 3397273 - protein, 20 aa, Plasmodium falciparum
KRRFHFLYNIKLYEYIYSFH

SEQ ID NO: 3397274 - protein, 24 aa, Plasmodium falciparum
KRSTDPLFLLTLEQKNKQLCIDIE

SEQ ID NO: 3397275 - protein, 22 aa, Plasmodium falciparum
KRSWIASWYDNGKRYYKSFSAK

SEQ ID NO: 3397276 - protein, 23 aa, Plasmodium falciparum
KSDFFFLNYISISKYILLILSKF

SEQ ID NO: 3397277 - protein, 21 aa, Plasmodium falciparum
KSILPFSFPGLLYLYNNKLLK

SEQ ID NO: 3397278 - protein, 26 aa, Plasmodium falciparum
KSKHTNVYYYFIQNIHLHKYNVYQYY

SEQ ID NO: 3397279 - protein, 19 aa, Plasmodium falciparum
KSKIFLNYKINCPKFLINT

SEQ ID NO: 3397280 - protein, 24 aa, Plasmodium falciparum
KSKSKFHMFFYKNKYSSSKYNNNN

SEQ ID NO: 3397281 - protein, 20 aa, Plasmodium falciparum
KSMWFNYNFDEHTFKEWVQK

SEQ ID NO: 3397282 - protein, 25 aa, Plasmodium falciparum
KSYELLRFLFDLYKNIYIKYLNGQD

SEQ ID NO: 3397283 - protein, 24 aa, Plasmodium falciparum
KTCTVIFFYWRKDIFNIQPQDVNV

SEQ ID NO: 3397284 - protein, 20 aa, Plasmodium falciparum
KTFKKVLMICAQKGFSKPPH

SEQ ID NO: 3397285 - protein, 29 aa, Plasmodium falciparum
KTIYYSLIHALFFFGILNVEITPLDNEEI

SEQ ID NO: 3397286 - protein, 22 aa, Plasmodium falciparum
KTPIVRFYFDKLFYKYLCLSSV

SEQ ID NO: 3397287 - protein, 17 aa, Plasmodium falciparum
KTSSWLSFGRKDKKDKK

SEQ ID NO: 3397288 - protein, 17 aa, Plasmodium falciparum
KTYVKINFFLKKYILQY

SEQ ID NO: 3397289 - protein, 22 aa, Plasmodium falciparum
KVFTRVLFRIWDIWQIRHYRNY

SEQ ID NO: 3397290 - protein, 19 aa, Plasmodium falciparum
KVHKHFFPIYKYGDASTAK

SEQ ID NO: 3397291 - protein, 25 aa, Plasmodium falciparum
KVKEIYYFHVFYHYIKLGFPEKEAA

SEQ ID NO: 3397292 - protein, 20 aa, Plasmodium falciparum
KVLIYFIDYLNEKYFKFGLT

SEQ ID NO: 3397293 - protein, 18 aa, Plasmodium falciparum
KVVFFSFLKKGKSIYHIN

SEQ ID NO: 3397294 - protein, 19 aa, Plasmodium falciparum
KWHFPYKLYRVILGHSGWV

SEQ ID NO: 3397295 - protein, 25 aa, Plasmodium falciparum
KWKEDMFRFFNIPLRSSISVRDLRI

SEQ ID NO: 3397296 - protein, 26 aa, Plasmodium falciparum
KWSIDKWSYAFVYFIDEKCAINAVNF

SEQ ID NO: 3397297 - protein, 20 aa, Plasmodium falciparum
KYFFIYIDQLILPFLVKYTW

SEQ ID NO: 3397298 - protein, 17 aa, Plasmodium falciparum
KYFMDNFLSLIDKKINI

SEQ ID NO: 3397299 - protein, 18 aa, Plasmodium falciparum
KYFMNRFYLWIRNICKQH

SEQ ID NO: 3397300 - protein, 17 aa, Plasmodium falciparum
KYFSVKKYGFEKARELA

SEQ ID NO: 3397301 - protein, 19 aa, Plasmodium falciparum
KYHFIIPDIFLYYKQLRFE

SEQ ID NO: 3397302 - protein, 20 aa, Plasmodium falciparum
KYICLKFRDSHVRKFVLNNQ

SEQ ID NO: 3397303 - protein, 20 aa, Plasmodium falciparum
KYIHMLMKNFNMYSNDLLNF

SEQ ID NO: 3397304 - protein, 19 aa, Plasmodium falciparum
KYILKYNIEYFKLAQFFSQ

SEQ ID NO: 3397305 - protein, 25 aa, Plasmodium falciparum
KYKKKLLVVILWIKIYMSVLEEYVK

SEQ ID NO: 3397306 - protein, 17 aa, Plasmodium falciparum
KYKYKVLSIIKHLLFFR

SEQ ID NO: 3397307 - protein, 19 aa, Plasmodium falciparum
KYLFHNHVFFLIISTKPFL

SEQ ID NO: 3397308 - protein, 18 aa, Plasmodium falciparum
LCRFKLTCNFKFLQFNQA

SEQ ID NO: 3397309 - protein, 23 aa, Plasmodium falciparum
LDDEILIANFPFNSLRDVENLTY

SEQ ID NO: 3397310 - protein, 19 aa, Plasmodium falciparum
LDLFRMPIILILHLKRFNN

SEQ ID NO: 3397311 - protein, 17 aa, Plasmodium falciparum
LDMFYVLASYYDIIKNI

SEQ ID NO: 3397312 - protein, 19 aa, Plasmodium falciparum
LDNWKVHFLYKIKSKLSVE

SEQ ID NO: 3397313 - protein, 19 aa, Plasmodium falciparum
LEFKALLFIPKRAPFDMFE

SEQ ID NO: 3397314 - protein, 17 aa, Plasmodium falciparum
LENFYKRRLQRLQNARN

SEQ ID NO: 3397315 - protein, 27 aa, Plasmodium falciparum
LENYFKITFYCLCGYLQYIKDDSDWKQ

SEQ ID NO: 3397316 - protein, 24 aa, Plasmodium falciparum
LFCSLFPYFYFYELKLKILLFFIH

SEQ ID NO: 3397317 - protein, 19 aa, Plasmodium falciparum
LFFLFTKFFHCYKISYVLK

SEQ ID NO: 3397318 - protein, 18 aa, Plasmodium falciparum
LFHVIHNLWCPHDFCLFQ

SEQ ID NO: 3397319 - protein, 17 aa, Plasmodium falciparum
LFKYCILLIFLLNNQLI

SEQ ID NO: 3397320 - protein, 20 aa, Plasmodium falciparum
LFLNIKEFIFKMHLNLENIK

SEQ ID NO: 3397321 - protein, 17 aa, Plasmodium falciparum
LGKKYCIKLLDFLLDAL

SEQ ID NO: 3397322 - protein, 17 aa, Plasmodium falciparum
LGNKLFFRLKISNIYYK

SEQ ID NO: 3397323 - protein, 22 aa, Plasmodium falciparum
LGYYFYIINIFFLLVKKNTVYK

SEQ ID NO: 3397324 - protein, 17 aa, Plasmodium falciparum
LICPAYFLWRSKLKENK

SEQ ID NO: 3397325 - protein, 20 aa, Plasmodium falciparum
LILLYNIYDMYIKGNFRIIK

SEQ ID NO: 3397326 - protein, 28 aa, Plasmodium falciparum
LILNNILFQYKYLLKHFLHLSNTFFDYY

SEQ ID NO: 3397327 - protein, 19 aa, Plasmodium falciparum
LIYNFLYKNNIFLKYFFSF

SEQ ID NO: 3397328 - protein, 17 aa, Plasmodium falciparum
LIYQLMKNDIYTYEKKL

SEQ ID NO: 3397329 - protein, 25 aa, Plasmodium falciparum
LKDKLYLLNILLKFYIQKIKNIMEQ

SEQ ID NO: 3397330 - protein, 20 aa, Plasmodium falciparum
LKEIFLIYPIKFMCVKKIQR

SEQ ID NO: 3397331 - protein, 23 aa, Plasmodium falciparum
LKKKNIFNLFNTNALYTTLKKTN

SEQ ID NO: 3397332 - protein, 26 aa, Plasmodium falciparum
LKKNNNWVRSPRWKKPVPLIICNSCQ

SEQ ID NO: 3397333 - protein, 23 aa, Plasmodium falciparum
LKNYNFILLFYSLSNYLFHHIFK

SEQ ID NO: 3397334 - protein, 17 aa, Plasmodium falciparum
LKRSITCLFILKPDIHI

SEQ ID NO: 3397335 - protein, 23 aa, Plasmodium falciparum
LKVLCVDYLRILKRLTPLWGSTD

SEQ ID NO: 3397336 - protein, 24 aa, Plasmodium falciparum
LKYDMYELLLLRFLKYECDYDDSE

SEQ ID NO: 3397337 - protein, 17 aa, Plasmodium falciparum
LLEIRKRVPRWGDYKCN

SEQ ID NO: 3397338 - protein, 24 aa, Plasmodium falciparum
LLIKNYFFFFKYFNFYNSMINFGL

SEQ ID NO: 3397339 - protein, 17 aa, Plasmodium falciparum
LLLICKYLDIIEIYQVE

SEQ ID NO: 3397340 - protein, 17 aa, Plasmodium falciparum
LLNYALKSGFKPLYIET

SEQ ID NO: 3397341 - protein, 17 aa, Plasmodium falciparum
LLPSDYFIKSVPIFFFR

SEQ ID NO: 3397342 - protein, 23 aa, Plasmodium falciparum
LLVYIHFIVFKYITLYSINEWNV

SEQ ID NO: 3397343 - protein, 17 aa, Plasmodium falciparum
LLWLLYQQGVVQIKNIH

SEQ ID NO: 3397344 - protein, 18 aa, Plasmodium falciparum
LMNILPLLKIEKPEEIDI

SEQ ID NO: 3397345 - protein, 19 aa, Plasmodium falciparum
LNIFNFLFKVYFLYPFTKY

SEQ ID NO: 3397346 - protein, 24 aa, Plasmodium falciparum
LNINSFLRFPKFHKILLDVPCSTD

SEQ ID NO: 3397347 - protein, 18 aa, Plasmodium falciparum
LNLKFFFPSLKNLNIKYT

SEQ ID NO: 3397348 - protein, 17 aa, Plasmodium falciparum
LNMLTPWEQKILALLYE

SEQ ID NO: 3397349 - protein, 21 aa, Plasmodium falciparum
LNRFLWLPILYTFVLPFRSGK

SEQ ID NO: 3397350 - protein, 28 aa, Plasmodium falciparum
LNTKSTYYILCAFLPRVILEAFLNSKGI

SEQ ID NO: 3397351 - protein, 17 aa, Plasmodium falciparum
LNVFNKYLIYSDALIIP

SEQ ID NO: 3397352 - protein, 25 aa, Plasmodium falciparum
LPGLWGERLFLKFNFKNTGFIDFEE

SEQ ID NO: 3397353 - protein, 19 aa, Plasmodium falciparum
LPIILGNILPYWTKDKNIK

SEQ ID NO: 3397354 - protein, 17 aa, Plasmodium falciparum
LPKKIFHDVWLPLGTLS

SEQ ID NO: 3397355 - protein, 18 aa, Plasmodium falciparum
LPLTYIIVPYYYNFNHID

SEQ ID NO: 3397356 - protein, 17 aa, Plasmodium falciparum
LPYLIYLFHQESGKVYS

SEQ ID NO: 3397357 - protein, 27 aa, Plasmodium falciparum
LQHLPKPLSVFYLPLCKLDLENDSVKY

SEQ ID NO: 3397358 - protein, 22 aa, Plasmodium falciparum
LQHNFDNFLLLYKNKKKKKKEM

SEQ ID NO: 3397359 - protein, 17 aa, Plasmodium falciparum
LQIGLFDHLRKAKDALE

SEQ ID NO: 3397360 - protein, 22 aa, Plasmodium falciparum
LQKLFMYLMSWYFSGYYSGKMS

SEQ ID NO: 3397361 - protein, 28 aa, Plasmodium falciparum
LQLTENVFLIWQFLKLYLSTSPQVRSII

SEQ ID NO: 3397362 - protein, 18 aa, Plasmodium falciparum
LQTETLFYIFYNLPRDVL

SEQ ID NO: 3397363 - protein, 23 aa, Plasmodium falciparum
LQYYDFFLILRKKKLYLWNLERT

SEQ ID NO: 3397364 - protein, 20 aa, Plasmodium falciparum
LRAPPDFFKTKLCKFFNTSG

SEQ ID NO: 3397365 - protein, 24 aa, Plasmodium falciparum
LRKSPVLLYLYYLKQIGLALSPLS

SEQ ID NO: 3397366 - protein, 19 aa, Plasmodium falciparum
LRRQKKITYILPSLNKKLR

SEQ ID NO: 3397367 - protein, 21 aa, Plasmodium falciparum
LRRTYILFSYFPEALTGLKKI

SEQ ID NO: 3397368 - protein, 22 aa, Plasmodium falciparum
LSEYYPYFYSLQNIKLSLFSLQ

SEQ ID NO: 3397369 - protein, 23 aa, Plasmodium falciparum
LSFPNICIFLLKRFTFDLQRMET

SEQ ID NO: 3397370 - protein, 18 aa, Plasmodium falciparum
LSGWSFTFKCETQHLTNV

SEQ ID NO: 3397371 - protein, 25 aa, Plasmodium falciparum
LSLFEAFIIYHFWYQKNSVDIKKNF

SEQ ID NO: 3397372 - protein, 17 aa, Plasmodium falciparum
LSLKYFFIYIDQLILPF

SEQ ID NO: 3397373 - protein, 20 aa, Plasmodium falciparum
LSLPDINRALLHSAYLDNIT

SEQ ID NO: 3397374 - protein, 23 aa, Plasmodium falciparum
LSNDFFLFPFKLLHRLKKAILIL

SEQ ID NO: 3397375 - protein, 20 aa, Plasmodium falciparum
LSTYLYWLYLRRNTNIFLQN

SEQ ID NO: 3397376 - protein, 24 aa, Plasmodium falciparum
LVPYPRIHFMLSSYAPIISAEKAY

SEQ ID NO: 3397377 - protein, 21 aa, Plasmodium falciparum
LWCLGIVIFELLVGFPPFTDD

SEQ ID NO: 3397378 - protein, 23 aa, Plasmodium falciparum
LWENDIIHFFFDLVLRKKEHFKN

SEQ ID NO: 3397379 - protein, 17 aa, Plasmodium falciparum
LWRCQWKENGKFKTKGF

SEQ ID NO: 3397380 - protein, 19 aa, Plasmodium falciparum
LWSDLYISRPFLKVLYEQK

SEQ ID NO: 3397381 - protein, 22 aa, Plasmodium falciparum
LYFKIRQLFIVQAPDYDCVNDD

SEQ ID NO: 3397382 - protein, 24 aa, Plasmodium falciparum
LYIRKWIYHIIYKKWFTPNNATST

SEQ ID NO: 3397383 - protein, 23 aa, Plasmodium falciparum
LYSLIRFIEFYPYAYYFCSKKDC

SEQ ID NO: 3397384 - protein, 17 aa, Plasmodium falciparum
LYYSIIFYVYYTNKNKI

SEQ ID NO: 3397385 - protein, 20 aa, Plasmodium falciparum
LYYTVIKKPMYINKIIFRCK

SEQ ID NO: 3397386 - protein, 29 aa, Plasmodium falciparum
MDNHPFYFYPRFYLPMYPYDYPHNETVPF

SEQ ID NO: 3397387 - protein, 31 aa, Plasmodium falciparum
MDNVYHLTGYLHRLLFLMKELDKKEHKINIG

SEQ ID NO: 3397388 - protein, 21 aa, Plasmodium falciparum
MDYFKITNYERKIINHKNFVH

SEQ ID NO: 3397389 - protein, 21 aa, Plasmodium falciparum
MECIKLIIHIFDKIISKMKKE

SEQ ID NO: 3397390 - protein, 17 aa, Plasmodium falciparum
MECLKVLIPLNMRDIFL

SEQ ID NO: 3397391 - protein, 18 aa, Plasmodium falciparum
MFPIKFNFEKLKKNIYVI

SEQ ID NO: 3397392 - protein, 34 aa, Plasmodium falciparum
MFVEIYYMKKIIRFIIFSFFKFHDIYSVFNVNTF

SEQ ID NO: 3397393 - protein, 30 aa, Plasmodium falciparum
MHMMHQELLYFILKFLLKNKKKKIQKDCFL

SEQ ID NO: 3397394 - protein, 22 aa, Plasmodium falciparum
MIEYFCNFLIKYFYNDINMDSI

SEQ ID NO: 3397395 - protein, 18 aa, Plasmodium falciparum
MIYKYYLKYILKNKSRYL

SEQ ID NO: 3397396 - protein, 19 aa, Plasmodium falciparum
MKFKTFPPYLFIHLKRFYA

SEQ ID NO: 3397397 - protein, 23 aa, Plasmodium falciparum
MKKDDLFVLPHTNTLLVDKKKNK

SEQ ID NO: 3397398 - protein, 25 aa, Plasmodium falciparum
MKKKRTYIFFINKTYKLFIHNYKNI

SEQ ID NO: 3397399 - protein, 24 aa, Plasmodium falciparum
MKTHKLLIRLLFRYASYSYINPKY

SEQ ID NO: 3397400 - protein, 20 aa, Plasmodium falciparum
MKVSLHLLLFRFLCLDKETG

SEQ ID NO: 3397401 - protein, 20 aa, Plasmodium falciparum
MLPVLFLRLKENFFVLDICA

SEQ ID NO: 3397402 - protein, 20 aa, Plasmodium falciparum
MLRYIEFCLYLEKLSLVKDG

SEQ ID NO: 3397403 - protein, 18 aa, Plasmodium falciparum
MLSFFIFFKFKESFIRDY

SEQ ID NO: 3397404 - protein, 17 aa, Plasmodium falciparum
MNKLHFFHFLKKKYKNF

SEQ ID NO: 3397405 - protein, 26 aa, Plasmodium falciparum
MNKNGLIEPYWWFFYNLYENACIHEG

SEQ ID NO: 3397406 - protein, 17 aa, Plasmodium falciparum
MNRFYLWIRNICKQHKD

SEQ ID NO: 3397407 - protein, 22 aa, Plasmodium falciparum
MPLYFKRYHFLLLDFIIETNNE

SEQ ID NO: 3397408 - protein, 27 aa, Plasmodium falciparum
MPYLTNYLIVLFLPKYRLLALINICKT

SEQ ID NO: 3397409 - protein, 23 aa, Plasmodium falciparum
MQCLSVFFKLIYTLHNYVTVKYK

SEQ ID NO: 3397410 - protein, 20 aa, Plasmodium falciparum
MRRYLLLALLLMNNNISYKR

SEQ ID NO: 3397411 - protein, 23 aa, Plasmodium falciparum
NAFKNILNILPNNKLKFIQLSNG

SEQ ID NO: 3397412 - protein, 21 aa, Plasmodium falciparum
NAGFMFYIKYEVPLLLNEGDN

SEQ ID NO: 3397413 - protein, 21 aa, Plasmodium falciparum
NAKFQAKYNLWRKKLHKFDTL

SEQ ID NO: 3397414 - protein, 28 aa, Plasmodium falciparum
NAYNISYMFIYQYYYVLHTKKEMMYNFY

SEQ ID NO: 3397415 - protein, 23 aa, Plasmodium falciparum
NCCICKIYLSYQPILFPCCFVSS

SEQ ID NO: 3397416 - protein, 25 aa, Plasmodium falciparum
NCYEDHFPFFLLPKEDSMILENMEL

SEQ ID NO: 3397417 - protein, 34 aa, Plasmodium falciparum
NDAYVFCRALVKYFDFLPENILLLTDSLPSNAYI

SEQ ID NO: 3397418 - protein, 17 aa, Plasmodium falciparum
NDDILWWYKNKKKNNYK

SEQ ID NO: 3397419 - protein, 22 aa, Plasmodium falciparum
NDFYYLIYFMTKQLYLRLKIKN

SEQ ID NO: 3397420 - protein, 22 aa, Plasmodium falciparum
NDIAFQLCPWKKGIQWNLLKKM

SEQ ID NO: 3397421 - protein, 19 aa, Plasmodium falciparum
NDIPIYMPNLSLLGNMNKK

SEQ ID NO: 3397422 - protein, 17 aa, Plasmodium falciparum
NDKGYMYPNYNTALNIM

SEQ ID NO: 3397423 - protein, 24 aa, Plasmodium falciparum
NDKYKICFYYIIKETLLANSLEQA

SEQ ID NO: 3397424 - protein, 24 aa, Plasmodium falciparum
NDMKFKQILLDNKTFNKLLVNELN

SEQ ID NO: 3397425 - protein, 17 aa, Plasmodium falciparum
NEELKIYILIFRSLCNE

SEQ ID NO: 3397426 - protein, 19 aa, Plasmodium falciparum
NEFIFLWPKTFHGGFNSGY

SEQ ID NO: 3397427 - protein, 18 aa, Plasmodium falciparum
NEIMLLKNILKYIIQLMS

SEQ ID NO: 3397428 - protein, 18 aa, Plasmodium falciparum
NELLKRNFLQSKSGTFVG

SEQ ID NO: 3397429 - protein, 24 aa, Plasmodium falciparum
NELTLLRFFMKYPIKKFIFIGDVK

SEQ ID NO: 3397430 - protein, 24 aa, Plasmodium falciparum
NENIPFSFLYHKVLTILKSHYNNH

SEQ ID NO: 3397431 - protein, 30 aa, Plasmodium falciparum
NERDLNFYIKIFNFLFEIITGKNIYYQIND

SEQ ID NO: 3397432 - protein, 18 aa, Plasmodium falciparum
NEYIYYYLNKYISKNMNI

SEQ ID NO: 3397433 - protein, 29 aa, Plasmodium falciparum
NFANFYFKPIYYYSLPYKIIHAWYTGPAH

SEQ ID NO: 3397434 - protein, 17 aa, Plasmodium falciparum
NFDIFKMKYFKKYYKFF

SEQ ID NO: 3397435 - protein, 26 aa, Plasmodium falciparum
NFDIIKFIMKWIFVHVIKIFVKDTYM

SEQ ID NO: 3397436 - protein, 23 aa, Plasmodium falciparum
NFEKPFLWLARRLSNQPNLVFVG

SEQ ID NO: 3397437 - protein, 23 aa, Plasmodium falciparum
NFENRVLTIIFYDSLFACSTSSL

SEQ ID NO: 3397438 - protein, 19 aa, Plasmodium falciparum
NFFIPKIDNLIYILNKMLQ

SEQ ID NO: 3397439 - protein, 21 aa, Plasmodium falciparum
NFFKWIPLTYIFDKYKFNDNN

SEQ ID NO: 3397440 - protein, 17 aa, Plasmodium falciparum
NFFLCRSELMYKNYDTQ

SEQ ID NO: 3397441 - protein, 19 aa, Plasmodium falciparum
NFIKPQVSVSLFLRIFLHD

SEQ ID NO: 3397442 - protein, 18 aa, Plasmodium falciparum
NFKLFLIIKIFNNISNKF

SEQ ID NO: 3397443 - protein, 23 aa, Plasmodium falciparum
NFKSSYILTFINRKQKKQRKIFP

SEQ ID NO: 3397444 - protein, 19 aa, Plasmodium falciparum
NFLFIYYKSFFKNKIYHLF

SEQ ID NO: 3397445 - protein, 17 aa, Plasmodium falciparum
NFYFIFYDGSNIHISPL

SEQ ID NO: 3397446 - protein, 17 aa, Plasmodium falciparum
NFYKSIKQFLKKYYVYN

SEQ ID NO: 3397447 - protein, 25 aa, Plasmodium falciparum
NGFTSIWFPLIYLKPVEEENKRDAE

SEQ ID NO: 3397448 - protein, 24 aa, Plasmodium falciparum
NGKKQIFFLFPLKSLINEKMTYLK

SEQ ID NO: 3397449 - protein, 24 aa, Plasmodium falciparum
NGKQFFNFNNLYFLPNALNTFDNN

SEQ ID NO: 3397450 - protein, 22 aa, Plasmodium falciparum
NHLCLVFEWMWGNLRIALKKYG

SEQ ID NO: 3397451 - protein, 20 aa, Plasmodium falciparum
NHNFYINNFLLNQHFNFNKN

SEQ ID NO: 3397452 - protein, 26 aa, Plasmodium falciparum
NHVSSHSFWLYLYINLEEAFTFSSLL

SEQ ID NO: 3397453 - protein, 17 aa, Plasmodium falciparum
NIEPIIISIIYKQNFWY

SEQ ID NO: 3397454 - protein, 20 aa, Plasmodium falciparum
NIFLMRCLKFLKSMKNILQL

SEQ ID NO: 3397455 - protein, 22 aa, Plasmodium falciparum
NIILLLFRIFFNYIITLNENND

SEQ ID NO: 3397456 - protein, 18 aa, Plasmodium falciparum
NIKIAQLKLLYYAFRKLS

SEQ ID NO: 3397457 - protein, 23 aa, Plasmodium falciparum
NIKIPVFLKNSPLYVLYPELNSY

SEQ ID NO: 3397458 - protein, 33 aa, Plasmodium falciparum
NIKKAHLYFFFLRICKLLYYNIRPIFIFDGNPP

SEQ ID NO: 3397459 - protein, 23 aa, Plasmodium falciparum
NIMNKFFLLNYYLKNIWKTNNTM

SEQ ID NO: 3397460 - protein, 21 aa, Plasmodium falciparum
NINKMMVYPPQNIITHGNTTT

SEQ ID NO: 3397461 - protein, 21 aa, Plasmodium falciparum
NINLYFIIPFVYLKVVLIKNR

SEQ ID NO: 3397462 - protein, 20 aa, Plasmodium falciparum
NINYFYFYILNQIDLCNKEE

SEQ ID NO: 3397463 - protein, 18 aa, Plasmodium falciparum
NIPIDFFHLGINSHKYIH

SEQ ID NO: 3397464 - protein, 23 aa, Plasmodium falciparum
NIPTLLVLLLYRILIEKPENIIK

SEQ ID NO: 3397465 - protein, 17 aa, Plasmodium falciparum
NIPWLYIGTLFSTFCWH

SEQ ID NO: 3397466 - protein, 21 aa, Plasmodium falciparum
NIQKLFFFHILIPLNNYNEEE

SEQ ID NO: 3397467 - protein, 23 aa, Plasmodium falciparum
NISKMFDAYLLQSYLKVCDFKLF

SEQ ID NO: 3397468 - protein, 24 aa, Plasmodium falciparum
NISTKLKPWIYKKITEYIGADEKD

SEQ ID NO: 3397469 - protein, 27 aa, Plasmodium falciparum
NIYDIFNNLLYYFLSKIDLNKLRENIS

SEQ ID NO: 3397470 - protein, 32 aa, Plasmodium falciparum
NKENKELIYVFKKQLDLIVILKKQINLLQNNK

SEQ ID NO: 3397471 - protein, 22 aa, Plasmodium falciparum
NKIKFPLIETWINKRLIEILGF

SEQ ID NO: 3397472 - protein, 28 aa, Plasmodium falciparum
NKIKLQKHIALLELIKYVILYSNTNIKK

SEQ ID NO: 3397473 - protein, 22 aa, Plasmodium falciparum
NKKNDCMFLFKDNLSISGLGNV

SEQ ID NO: 3397474 - protein, 21 aa, Plasmodium falciparum
NKLLLILPPNRITFLFSATMT

SEQ ID NO: 3397475 - protein, 28 aa, Plasmodium falciparum
NKLTFEKFDLLYEQIILVGITKLDEIIG

SEQ ID NO: 3397476 - protein, 26 aa, Plasmodium falciparum
NKNVERSLPYFNWLVSIVLDNKIDME

SEQ ID NO: 3397477 - protein, 25 aa, Plasmodium falciparum
NKRIFFSFFSYFMPKNDLNFIFEHF

SEQ ID NO: 3397478 - protein, 18 aa, Plasmodium falciparum
NKRKRDFLFFINALRRND

SEQ ID NO: 3397479 - protein, 22 aa, Plasmodium falciparum
NKRSYFIKNLYLSSLFSSDYIT

SEQ ID NO: 3397480 - protein, 25 aa, Plasmodium falciparum
NKSDPFFFLFLFNFIIKNIQNNKMM

SEQ ID NO: 3397481 - protein, 24 aa, Plasmodium falciparum
NKSFNGPFLQFLLSDENNEYSSMF

SEQ ID NO: 3397482 - protein, 21 aa, Plasmodium falciparum
NKTIFFSRLPPYNLLPLCSGC

SEQ ID NO: 3397483 - protein, 22 aa, Plasmodium falciparum
NKTKLFDMLKYLSSIKYKSNNN

SEQ ID NO: 3397484 - protein, 24 aa, Plasmodium falciparum
NKTPFHFHWFKDDYIYFYKNKETE

SEQ ID NO: 3397485 - protein, 29 aa, Plasmodium falciparum
NKTYPFNYNEPFYFIYKPNKDMSMDHHHH

SEQ ID NO: 3397486 - protein, 20 aa, Plasmodium falciparum
NKYFHIYKHGIIKVFNFDFA

SEQ ID NO: 3397487 - protein, 17 aa, Plasmodium falciparum
NKYLFLFRVFQAEILMF

SEQ ID NO: 3397488 - protein, 25 aa, Plasmodium falciparum
NLAKNNLIWYKLFTKVFLGNFKKGN

SEQ ID NO: 3397489 - protein, 23 aa, Plasmodium falciparum
NLIPYPFFNFLLSSLSPCIESES

SEQ ID NO: 3397490 - protein, 21 aa, Plasmodium falciparum
NLKEFFFIINVINQLYKKQIS

SEQ ID NO: 3397491 - protein, 21 aa, Plasmodium falciparum
NLLINFFLQFPSLNKKLEYNK

SEQ ID NO: 3397492 - protein, 23 aa, Plasmodium falciparum
NLMEHFFSFLLRKTDFITNSHNV

SEQ ID NO: 3397493 - protein, 17 aa, Plasmodium falciparum
NLNYMYNPLNYYNMNKY

SEQ ID NO: 3397494 - protein, 24 aa, Plasmodium falciparum
NLSKAPMFNFDFSKGLLNNNEKEK

SEQ ID NO: 3397495 - protein, 24 aa, Plasmodium falciparum
NLYVMFQLPIILYNVLFEKTINSF

SEQ ID NO: 3397496 - protein, 20 aa, Plasmodium falciparum
NMHDTYLYYPNFKMFISENN

SEQ ID NO: 3397497 - protein, 17 aa, Plasmodium falciparum
NMKIIFYLSNLLTKEVQ

SEQ ID NO: 3397498 - protein, 17 aa, Plasmodium falciparum
NMKILFTFLNIYAKQNS

SEQ ID NO: 3397499 - protein, 17 aa, Plasmodium falciparum
NMKYYFSTILKKKPCYN

SEQ ID NO: 3397500 - protein, 26 aa, Plasmodium falciparum
NMNEAFLYFIQLLQGMWYIQEMNIVH

SEQ ID NO: 3397501 - protein, 22 aa, Plasmodium falciparum
NMNNRLYLLNKRSSLNNNYSPN

SEQ ID NO: 3397502 - protein, 24 aa, Plasmodium falciparum
NMQRIDIFNMILMRDMLSNLDENN

SEQ ID NO: 3397503 - protein, 23 aa, Plasmodium falciparum
NMYKAYIWYDKKKYLYIWNKNIK

SEQ ID NO: 3397504 - protein, 29 aa, Plasmodium falciparum
NNCDVYYVFKYLLLPILEKFRPEFIFISC

SEQ ID NO: 3397505 - protein, 20 aa, Plasmodium falciparum
NNCIYIWNLSLLTNTIIMNK

SEQ ID NO: 3397506 - protein, 23 aa, Plasmodium falciparum
NNDLIYFFPKYKLIIHPTLLNVN

SEQ ID NO: 3397507 - protein, 23 aa, Plasmodium falciparum
NNEKYLQWFDTIYTVCVKLDDLC

SEQ ID NO: 3397508 - protein, 23 aa, Plasmodium falciparum
NNFILYFMEYIGRILLDIKLCCK

SEQ ID NO: 3397509 - protein, 18 aa, Plasmodium falciparum
NNFLCVELLPLFKKNLEN

SEQ ID NO: 3397510 - protein, 25 aa, Plasmodium falciparum
NNGDILFFYFCGYSIKLIDSKFTEN

SEQ ID NO: 3397511 - protein, 17 aa, Plasmodium falciparum
NNIVLPNPFLPYVKDQN

SEQ ID NO: 3397512 - protein, 24 aa, Plasmodium falciparum
NNIYNLYCYLIKNTFFKISDKNVN

SEQ ID NO: 3397513 - protein, 29 aa, Plasmodium falciparum
NNKGMNLDLFLYITKQYKILKNLLTKGEL

SEQ ID NO: 3397514 - protein, 22 aa, Plasmodium falciparum
NNKTWRLTLFYRPYFYLKTKNI

SEQ ID NO: 3397515 - protein, 21 aa, Plasmodium falciparum
NNKWYLIFVNLYLPYNKNNNQ

SEQ ID NO: 3397516 - protein, 21 aa, Plasmodium falciparum
NNLCCGLLYIPYSYIVVLLNR

SEQ ID NO: 3397517 - protein, 19 aa, Plasmodium falciparum
NNMSYLNNTIPLNCINVFN

SEQ ID NO: 3397518 - protein, 24 aa, Plasmodium falciparum
NNNCYYYYNYVLPYTLNLDKKYIN

SEQ ID NO: 3397519 - protein, 23 aa, Plasmodium falciparum
NNNNYYYYYYINNYNRSMQGQNN

SEQ ID NO: 3397520 - protein, 23 aa, Plasmodium falciparum
NNNPCYMDLLKNSKFKYFLNYEN

SEQ ID NO: 3397521 - protein, 23 aa, Plasmodium falciparum
NNPFDYFYLIRELKIVASMLNIA

SEQ ID NO: 3397522 - protein, 18 aa, Plasmodium falciparum
NNSFLSNSLFPLLNKLQL

SEQ ID NO: 3397523 - protein, 30 aa, Plasmodium falciparum
NNSLTFIPKIFTFSTFFFQSLNFNGSYNYS

SEQ ID NO: 3397524 - protein, 25 aa, Plasmodium falciparum
NNTYFLKIKLYILCLIKLIEKYKLD

SEQ ID NO: 3397525 - protein, 26 aa, Plasmodium falciparum
NPKRKNYIFLFKYNKFFYKMLENHRE

SEQ ID NO: 3397526 - protein, 19 aa, Plasmodium falciparum
NPMLFFEKYNYMGLKYGAL

SEQ ID NO: 3397527 - protein, 26 aa, Plasmodium falciparum
NPNSIRNMFILLRNKLSNLNVKNTMN

SEQ ID NO: 3397528 - protein, 18 aa, Plasmodium falciparum
NQNNFYFIFYDGSNIHIS

SEQ ID NO: 3397529 - protein, 28 aa, Plasmodium falciparum
NRDHFKKYFFLLLYRYHISRHTYPNYVF

SEQ ID NO: 3397530 - protein, 23 aa, Plasmodium falciparum
NRLQDFIIQLLKNNIKYITIFQE

SEQ ID NO: 3397531 - protein, 24 aa, Plasmodium falciparum
NSKGFLIMNFLITSSYYNLKNDIL

SEQ ID NO: 3397532 - protein, 17 aa, Plasmodium falciparum
NSQYYYHPLYQLYFDNN

SEQ ID NO: 3397533 - protein, 27 aa, Plasmodium falciparum
NSSFPPYKFISYLRPKLTPKAYHLKNN

SEQ ID NO: 3397534 - protein, 17 aa, Plasmodium falciparum
NTIKAIGIVFKKWKFKN

SEQ ID NO: 3397535 - protein, 19 aa, Plasmodium falciparum
NTLEFFLTKKYLKSSELII

SEQ ID NO: 3397536 - protein, 22 aa, Plasmodium falciparum
NTNDQMCLSCSGLPCHCKVGEA

SEQ ID NO: 3397537 - protein, 26 aa, Plasmodium falciparum
NTVVPSLWLYASISFYLTKFHLENFK

SEQ ID NO: 3397538 - protein, 24 aa, Plasmodium falciparum
NVGKIFLHQLFSWILYGQLIDPYN

SEQ ID NO: 3397539 - protein, 27 aa, Plasmodium falciparum
NVKLKYINIITYYMDLLSPFNKCYSEK

SEQ ID NO: 3397540 - protein, 27 aa, Plasmodium falciparum
NVKNVIIHIPLFLRYFIQTHVSSTKAR

SEQ ID NO: 3397541 - protein, 23 aa, Plasmodium falciparum
NVNIIFLLYPPNCGVKRLVELTC

SEQ ID NO: 3397542 - protein, 17 aa, Plasmodium falciparum
NVQIFLPVDFKIADNFD

SEQ ID NO: 3397543 - protein, 24 aa, Plasmodium falciparum
NVSKWISYNFRRIFIRCLKEANEE

SEQ ID NO: 3397544 - protein, 24 aa, Plasmodium falciparum
NVVKYFESFFWPPCYLVIVCEYLS

SEQ ID NO: 3397545 - protein, 23 aa, Plasmodium falciparum
NVYKQRIFFLKLKSSTLIIQKNY

SEQ ID NO: 3397546 - protein, 23 aa, Plasmodium falciparum
NYALGMNMILFISGRFVCRQKGI

SEQ ID NO: 3397547 - protein, 23 aa, Plasmodium falciparum
NYLEKHFPFIKGYRNKYEITDDL

SEQ ID NO: 3397548 - protein, 28 aa, Plasmodium falciparum
NYLLGNPVNLFWLGGPLPGLTILHNMKK

SEQ ID NO: 3397549 - protein, 24 aa, Plasmodium falciparum
NYNFYNFLFNLLYINFYDLCSTFF

SEQ ID NO: 3397550 - protein, 20 aa, Plasmodium falciparum
NYPDILPIQYLSKIQLNDVK

SEQ ID NO: 3397551 - protein, 24 aa, Plasmodium falciparum
NYPYGNLPNIYYPDGYYANYCYPN

SEQ ID NO: 3397552 - protein, 25 aa, Plasmodium falciparum
NYYKLPWVHRGISKYLLIKNKNFDD

SEQ ID NO: 3397553 - protein, 25 aa, Plasmodium falciparum
NYYNIMKNYYFAFFLDLYKNNEDSK

SEQ ID NO: 3397554 - protein, 24 aa, Plasmodium falciparum
PCIKYIFRFFFLKYASITTVSTNL

SEQ ID NO: 3397555 - protein, 26 aa, Plasmodium falciparum
PCRIYEKFILSLLLKYKLIPQCFDLV

SEQ ID NO: 3397556 - protein, 24 aa, Plasmodium falciparum
PDEMKIFLILCKSKILFTYRSNFL

SEQ ID NO: 3397557 - protein, 25 aa, Plasmodium falciparum
PFDYLNYYFLCEIVFDDFSFKSPYH

SEQ ID NO: 3397558 - protein, 18 aa, Plasmodium falciparum
PFFNIYDFLFFTISPLSR

SEQ ID NO: 3397559 - protein, 26 aa, Plasmodium falciparum
PFHLNIYNILYLLLNASLYNFDISLI

SEQ ID NO: 3397560 - protein, 20 aa, Plasmodium falciparum
PIPHLFSMKPGCASLPFLGV

SEQ ID NO: 3397561 - protein, 25 aa, Plasmodium falciparum
PKISKYLLKKWGFNKAHSLAVHTVK

SEQ ID NO: 3397562 - protein, 23 aa, Plasmodium falciparum
PKKLIFYFPQFLKTWLKIMAHGT

SEQ ID NO: 3397563 - protein, 19 aa, Plasmodium falciparum
PLCSFLLPMLSVDPQTRPS

SEQ ID NO: 3397564 - protein, 32 aa, Plasmodium falciparum
PLISKKYIYLILEYFLFLLKDNLKKIPSNLVE

SEQ ID NO: 3397565 - protein, 27 aa, Plasmodium falciparum
PLKRREYFFYLYIAVSLKYVEERIANV

SEQ ID NO: 3397566 - protein, 24 aa, Plasmodium falciparum
PLLNIYFNFFYIYGINVKALYKWK

SEQ ID NO: 3397567 - protein, 28 aa, Plasmodium falciparum
PNPLPGPQPIFAPPLPYTNTLTSTGNTT

SEQ ID NO: 3397568 - protein, 24 aa, Plasmodium falciparum
PNSYPFFLIYYVSFCYRNSINAWN

SEQ ID NO: 3397569 - protein, 25 aa, Plasmodium falciparum
PPGANLFLYGIPLKWTELNLIQLVN

SEQ ID NO: 3397570 - protein, 25 aa, Plasmodium falciparum
PPNYYGNYLYYYAAPYGYGPVGLPE

SEQ ID NO: 3397571 - protein, 21 aa, Plasmodium falciparum
PQGLIAPIQRIKYTGPTILDK

SEQ ID NO: 3397572 - protein, 17 aa, Plasmodium falciparum
PSGALVSFLQKALIFIY

SEQ ID NO: 3397573 - protein, 23 aa, Plasmodium falciparum
PSHPYFYYYQYKLHGLFLDIQEK

SEQ ID NO: 3397574 - protein, 23 aa, Plasmodium falciparum
PSKKKLHYLLYKTLEDLNILNEI

SEQ ID NO: 3397575 - protein, 22 aa, Plasmodium falciparum
PSYKYFYIPLAKFLGSFFPSLR

SEQ ID NO: 3397576 - protein, 18 aa, Plasmodium falciparum
PSYTFYGYILRPFNEYTN

SEQ ID NO: 3397577 - protein, 17 aa, Plasmodium falciparum
PTHILIYSFPPLTSPVN

SEQ ID NO: 3397578 - protein, 18 aa, Plasmodium falciparum
PVPIYVPCYIEVPIPAQY

SEQ ID NO: 3397579 - protein, 18 aa, Plasmodium falciparum
PYSYYYIPPFNETNIRNS

SEQ ID NO: 3397580 - protein, 25 aa, Plasmodium falciparum
PYYYMLSIRYFVPRFFILFEKNYYA

SEQ ID NO: 3397581 - protein, 17 aa, Plasmodium falciparum
QCCSHPLLLFSKPFFEE

SEQ ID NO: 3397582 - protein, 17 aa, Plasmodium falciparum
QCSSFLNIFFKVFEAAK

SEQ ID NO: 3397583 - protein, 25 aa, Plasmodium falciparum
QDCHEFLLLVFDFIHNMVKVIDESV

SEQ ID NO: 3397584 - protein, 25 aa, Plasmodium falciparum
QEYSTYNIFIWFLNYMHSKLEIRKS

SEQ ID NO: 3397585 - protein, 20 aa, Plasmodium falciparum
QFIYNPYFKKELKGPYIKKM

SEQ ID NO: 3397586 - protein, 28 aa, Plasmodium falciparum
QFKARYYILFDNLLYYYDKKRNLKPRGF

SEQ ID NO: 3397587 - protein, 23 aa, Plasmodium falciparum
QFSKIFYIYNPLSIWIKDLCIFN

SEQ ID NO: 3397588 - protein, 35 aa, Plasmodium falciparum
QGPFSSELMFYWWCLNYFPYDLPIRFNESMPWVRF

SEQ ID NO: 3397589 - protein, 23 aa, Plasmodium falciparum
QHDVRQIFFNAFTYHKVKNCVWN

SEQ ID NO: 3397590 - protein, 21 aa, Plasmodium falciparum
QHYIYIYIFQIEKYPKMASDI

SEQ ID NO: 3397591 - protein, 19 aa, Plasmodium falciparum
QIIFNIFKQVDNSNFLEIL

SEQ ID NO: 3397592 - protein, 19 aa, Plasmodium falciparum
QIIFYKEIKISYFINILNI

SEQ ID NO: 3397593 - protein, 23 aa, Plasmodium falciparum
QIKQDIFIIIWICLKLGIDSLNV

SEQ ID NO: 3397594 - protein, 27 aa, Plasmodium falciparum
QIKTFREAFLYILGWDIKIEQNDEEIF

SEQ ID NO: 3397595 - protein, 18 aa, Plasmodium falciparum
QIMIMKKKNLLLSNRLND

SEQ ID NO: 3397596 - protein, 25 aa, Plasmodium falciparum
QIQIKLYWIYYKIQMFEQSNLLSCD

SEQ ID NO: 3397597 - protein, 24 aa, Plasmodium falciparum
QKQKKRLLGIVKLIGELFQRQIVS

SEQ ID NO: 3397598 - protein, 20 aa, Plasmodium falciparum
QLVYLDGWPHIILTSIPGVE

SEQ ID NO: 3397599 - protein, 19 aa, Plasmodium falciparum
QNIFIQKGDYKKVLNQMGE

SEQ ID NO: 3397600 - protein, 20 aa, Plasmodium falciparum
QNKIFFFLKDTIQKYKNIQA

SEQ ID NO: 3397601 - protein, 22 aa, Plasmodium falciparum
QNKKKIRQLFLKKLSMLSNMKS

SEQ ID NO: 3397602 - protein, 20 aa, Plasmodium falciparum
QNLLMAEPFNKYYKLYIPNN

SEQ ID NO: 3397603 - protein, 25 aa, Plasmodium falciparum
QNSIFDIFPLFRFLGIKPYGTIEWW

SEQ ID NO: 3397604 - protein, 23 aa, Plasmodium falciparum
QPVPMPFFPQVPYPNYYASSHGM

SEQ ID NO: 3397605 - protein, 18 aa, Plasmodium falciparum
QQQDLLLSYLLLESLYSI

SEQ ID NO: 3397606 - protein, 25 aa, Plasmodium falciparum
QSIYEKRKVLLTKLLLLFKKNVDTQ

SEQ ID NO: 3397607 - protein, 25 aa, Plasmodium falciparum
QSKEKYIIALPFFLNTSPKSSNTRN

SEQ ID NO: 3397608 - protein, 24 aa, Plasmodium falciparum
QSQQLLLDLGLYCNGIKLNIEHFK

SEQ ID NO: 3397609 - protein, 26 aa, Plasmodium falciparum
QTEYHLQGIKYWWKNIHSFLGLNSFN

SEQ ID NO: 3397610 - protein, 23 aa, Plasmodium falciparum
QVDEDYLYALKLNEALNGSGAND

SEQ ID NO: 3397611 - protein, 23 aa, Plasmodium falciparum
QVIYLLSIFFKKIVHLILPQLLN

SEQ ID NO: 3397612 - protein, 18 aa, Plasmodium falciparum
QVSNLPNFFLCRSELMYK

SEQ ID NO: 3397613 - protein, 20 aa, Plasmodium falciparum
QYKDLLKEYIFLELLVIEYE

SEQ ID NO: 3397614 - protein, 20 aa, Plasmodium falciparum
QYKEYLLHKTVYPRNICRNE

SEQ ID NO: 3397615 - protein, 19 aa, Plasmodium falciparum
QYYYHPLYQLYFDNNTKYY

SEQ ID NO: 3397616 - protein, 36 aa, Plasmodium falciparum
RADIEGFLYIVKRSIKPYYRLIITNKKNEKHLLQDI

SEQ ID NO: 3397617 - protein, 17 aa, Plasmodium falciparum
RAKQFIYNPYFKKELKG

SEQ ID NO: 3397618 - protein, 22 aa, Plasmodium falciparum
RAPYFLTKFFTFAQSYLNFTSN

SEQ ID NO: 3397619 - protein, 17 aa, Plasmodium falciparum
RCPYYISLPSYLRYIPV

SEQ ID NO: 3397620 - protein, 17 aa, Plasmodium falciparum
RDKNKFLLLQNRRLKCI

SEQ ID NO: 3397621 - protein, 22 aa, Plasmodium falciparum
RDKNLLFLSFHNMTMKYKCVEI

SEQ ID NO: 3397622 - protein, 22 aa, Plasmodium falciparum
REDYFYKVFYFYHIYLSNEMKI

SEQ ID NO: 3397623 - protein, 17 aa, Plasmodium falciparum
REKICFKMLKSIDIYIT

SEQ ID NO: 3397624 - protein, 25 aa, Plasmodium falciparum
REKTCPFLLRLFYKVDKEYNVDDMD

SEQ ID NO: 3397625 - protein, 19 aa, Plasmodium falciparum
RENKILLWLLYQQGVVQIK

SEQ ID NO: 3397626 - protein, 19 aa, Plasmodium falciparum
RFLLYFKEISRRLTITNNN

SEQ ID NO: 3397627 - protein, 23 aa, Plasmodium falciparum
RFVEKIYYLLKDKKKNMLPEEEL

SEQ ID NO: 3397628 - protein, 34 aa, Plasmodium falciparum
RILDNISWTILLKKYIFIILYTMKHCIVFNDKEE

SEQ ID NO: 3397629 - protein, 25 aa, Plasmodium falciparum
RISNKDLIRKIIELQYCVINLSDSM

SEQ ID NO: 3397630 - protein, 34 aa, Plasmodium falciparum
RISVISPVILLLIFKNMNIINLYKIFISCLKCDN

SEQ ID NO: 3397631 - protein, 23 aa, Plasmodium falciparum
RKFLKIFIQLFLDKILCIRKYII

SEQ ID NO: 3397632 - protein, 21 aa, Plasmodium falciparum
RKILGGYIIFPCKLIHEKEDM

SEQ ID NO: 3397633 - protein, 23 aa, Plasmodium falciparum
RKKKLICIIWIKIYMMIIEEHKK

SEQ ID NO: 3397634 - protein, 23 aa, Plasmodium falciparum
RKRKFFTNILPYKNKKKKLPYTI

SEQ ID NO: 3397635 - protein, 23 aa, Plasmodium falciparum
RKSFNKYKFLLNLSKTLLSKKYL

SEQ ID NO: 3397636 - protein, 24 aa, Plasmodium falciparum
RLNLRKIIYKYLILELFTNAQSCN

SEQ ID NO: 3397637 - protein, 19 aa, Plasmodium falciparum
RNDKYLYEYGYYLNKHMIE

SEQ ID NO: 3397638 - protein, 24 aa, Plasmodium falciparum
RNMEFKLIITKFIDGFIKCTESKI

SEQ ID NO: 3397639 - protein, 23 aa, Plasmodium falciparum
RNNKILPYYYFFDLNNFTQNMKQ

SEQ ID NO: 3397640 - protein, 17 aa, Plasmodium falciparum
RNWIAIFYEKMADILFV

SEQ ID NO: 3397641 - protein, 25 aa, Plasmodium falciparum
RNYNRPLMPLLVKKKKKNFLSHKNR

SEQ ID NO: 3397642 - protein, 19 aa, Plasmodium falciparum
RPYVLYMNNPLYIWDISND

SEQ ID NO: 3397643 - protein, 21 aa, Plasmodium falciparum
RRILFYKTKICPWYIKGKCER

SEQ ID NO: 3397644 - protein, 25 aa, Plasmodium falciparum
RSFFLNYFYFPVYLKTFFFKCRNVK

SEQ ID NO: 3397645 - protein, 24 aa, Plasmodium falciparum
RSNERFFFLFILPDFMAFEDLPDY

SEQ ID NO: 3397646 - protein, 23 aa, Plasmodium falciparum
RSSYYIYCRTKKYSFPRIVNVFS

SEQ ID NO: 3397647 - protein, 23 aa, Plasmodium falciparum
RTPEFLDFLLFYILKKENIHFFE

SEQ ID NO: 3397648 - protein, 18 aa, Plasmodium falciparum
RVLFFIPFVVDLLIYHMD

SEQ ID NO: 3397649 - protein, 17 aa, Plasmodium falciparum
RYFFNFFQVYGILSEES

SEQ ID NO: 3397650 - protein, 23 aa, Plasmodium falciparum
RYKNIIFFIYGKWSQEIYIAYVK

SEQ ID NO: 3397651 - protein, 24 aa, Plasmodium falciparum
SCFSKICFYFADGPWRRTYCKYGY

SEQ ID NO: 3397652 - protein, 18 aa, Plasmodium falciparum
SCLFLLDPLRKFFGNRVF

SEQ ID NO: 3397653 - protein, 24 aa, Plasmodium falciparum
SCPMWHWYYPYYYAPLSSDLIVDN

SEQ ID NO: 3397654 - protein, 26 aa, Plasmodium falciparum
SCYAIWLCMNEIYPSWFDISIHPAQF

SEQ ID NO: 3397655 - protein, 22 aa, Plasmodium falciparum
SDDYLLYYMYNNIKLNIDIISK

SEQ ID NO: 3397656 - protein, 23 aa, Plasmodium falciparum
SDSKFWFFLFNNKYSHLFFYDKN

SEQ ID NO: 3397657 - protein, 24 aa, Plasmodium falciparum
SDSVLYFYGAPWWLNKIRRGQKIG

SEQ ID NO: 3397658 - protein, 26 aa, Plasmodium falciparum
SEINMLINNFIYILKIMNKHKQMLEN

SEQ ID NO: 3397659 - protein, 19 aa, Plasmodium falciparum
SEKSIFVPLLSKLSDKNYP

SEQ ID NO: 3397660 - protein, 17 aa, Plasmodium falciparum
SEMQFWKSYFFNIDIIY

SEQ ID NO: 3397661 - protein, 27 aa, Plasmodium falciparum
SEWKICPNFIFRILFIAKSRANNFIYP

SEQ ID NO: 3397662 - protein, 24 aa, Plasmodium falciparum
SEWSKKLLCLRLVKNPELLQKKYN

SEQ ID NO: 3397663 - protein, 25 aa, Plasmodium falciparum
SFEIDLTHIFFFNKKLYKLIIEYPS

SEQ ID NO: 3397664 - protein, 19 aa, Plasmodium falciparum
SFILWLRYEYDQDAALFMN

SEQ ID NO: 3397665 - protein, 17 aa, Plasmodium falciparum
SFKFCYFFQCLVENELF

SEQ ID NO: 3397666 - protein, 20 aa, Plasmodium falciparum
SFRIPKFFHFIDNITNTESF

SEQ ID NO: 3397667 - protein, 19 aa, Plasmodium falciparum
SGSPFFLPSFMDCSIHNDD

SEQ ID NO: 3397668 - protein, 20 aa, Plasmodium falciparum
SHMWPLFIKPILDGVLEPIV

SEQ ID NO: 3397669 - protein, 26 aa, Plasmodium falciparum
SIDDKVFLMFILKYIKKYILHIIYKT

SEQ ID NO: 3397670 - protein, 19 aa, Plasmodium falciparum
SIFSEKIYKYALIFSPILK

SEQ ID NO: 3397671 - protein, 18 aa, Plasmodium falciparum
SISFLPYFNLSMLWQLAE

SEQ ID NO: 3397672 - protein, 24 aa, Plasmodium falciparum
SISKYILLILSKFLNIHLIDKFEC

SEQ ID NO: 3397673 - protein, 21 aa, Plasmodium falciparum
SIYFIYLISTRAGGLGINLTA

SEQ ID NO: 3397674 - protein, 25 aa, Plasmodium falciparum
SKAMLQLIYWHKWLTEEEKDQEEEI

SEQ ID NO: 3397675 - protein, 27 aa, Plasmodium falciparum
SKCYDDIFFLLKILAKHLEIKKIPSAY

SEQ ID NO: 3397676 - protein, 21 aa, Plasmodium falciparum
SKKDWYLLNNFAIKMMQYRKG

SEQ ID NO: 3397677 - protein, 22 aa, Plasmodium falciparum
SKKILGFPLIKDFSKGLSTLEP

SEQ ID NO: 3397678 - protein, 17 aa, Plasmodium falciparum
SKKKLMNILPLLKIEKP

SEQ ID NO: 3397679 - protein, 20 aa, Plasmodium falciparum
SKMKIKIQNLLKLIGLLKAQ

SEQ ID NO: 3397680 - protein, 25 aa, Plasmodium falciparum
SKNDNKWLRFFRFNKKTNPNEEKIL

SEQ ID NO: 3397681 - protein, 18 aa, Plasmodium falciparum
SKNPFLSVFNFNSLILAN

SEQ ID NO: 3397682 - protein, 35 aa, Plasmodium falciparum
SLDIECFLFKIKYYFYKSVLFLYQEGIKSYLGDVA

SEQ ID NO: 3397683 - protein, 20 aa, Plasmodium falciparum
SLFHKFIIYHTLPHNISLRK

SEQ ID NO: 3397684 - protein, 24 aa, Plasmodium falciparum
SLGKHLLIGSSLKKGISVSVRGRT

SEQ ID NO: 3397685 - protein, 23 aa, Plasmodium falciparum
SLGVLLYEMLVGDVPFDGTKTQI

SEQ ID NO: 3397686 - protein, 17 aa, Plasmodium falciparum
SLHFFLKNNNYLNNNNN

SEQ ID NO: 3397687 - protein, 18 aa, Plasmodium falciparum
SLIFLYIKNLFYLQEEYN

SEQ ID NO: 3397688 - protein, 24 aa, Plasmodium falciparum
SLTQFFFNFIIKKNQYNFFLNKSY

SEQ ID NO: 3397689 - protein, 24 aa, Plasmodium falciparum
SLVILSIIYVLFHQNVFTSKWNEP

SEQ ID NO: 3397690 - protein, 17 aa, Plasmodium falciparum
SLYMLHPYFKNHKTKII

SEQ ID NO: 3397691 - protein, 23 aa, Plasmodium falciparum
SMNNDLLNLLYLYELSQKNKNQN

SEQ ID NO: 3397692 - protein, 22 aa, Plasmodium falciparum
SNDIYLIILPFNFIKINFKNIA

SEQ ID NO: 3397693 - protein, 23 aa, Plasmodium falciparum
SNIFLHFDIFIDNKTYNFIFNNC

SEQ ID NO: 3397694 - protein, 25 aa, Plasmodium falciparum
SNKYRRFYRFLLYDGKSFIYAYEQE

SEQ ID NO: 3397695 - protein, 21 aa, Plasmodium falciparum
SNLFFFCFEFFLKYLCIPGKI

SEQ ID NO: 3397696 - protein, 24 aa, Plasmodium falciparum
SNNKFLYIIFSDIDIFPRQCYLIL

SEQ ID NO: 3397697 - protein, 28 aa, Plasmodium falciparum
SNSKKISILFLLRWILCGKQIAEKTKRS

SEQ ID NO: 3397698 - protein, 26 aa, Plasmodium falciparum
SNVNYSSYFFIPPLEFIVSHLNKLHK

SEQ ID NO: 3397699 - protein, 18 aa, Plasmodium falciparum
SPANLWMWFEPYLLEEDE

SEQ ID NO: 3397700 - protein, 17 aa, Plasmodium falciparum
SQKIDILIKPNLKKGEN

SEQ ID NO: 3397701 - protein, 24 aa, Plasmodium falciparum
SQPVPMPFFPQVPYPNYYASSHGM

SEQ ID NO: 3397702 - protein, 19 aa, Plasmodium falciparum
SRLFLLQYNGYIWSWSILP

SEQ ID NO: 3397703 - protein, 17 aa, Plasmodium falciparum
SRLFLYIEDIHKLKQAL

SEQ ID NO: 3397704 - protein, 19 aa, Plasmodium falciparum
SRRSNIVNHLLPFRRSRNF

SEQ ID NO: 3397705 - protein, 19 aa, Plasmodium falciparum
SSFLNIFFKVFEAAKKNRP

SEQ ID NO: 3397706 - protein, 35 aa, Plasmodium falciparum
SSISNTLDTLTFYQLILIIISIVNFCRKKSQTYNK

SEQ ID NO: 3397707 - protein, 21 aa, Plasmodium falciparum
SSVIPLYKLLFVKAFSLSVTQ

SEQ ID NO: 3397708 - protein, 19 aa, Plasmodium falciparum
SSYLYYFKLINKKKLNMKI

SEQ ID NO: 3397709 - protein, 21 aa, Plasmodium falciparum
STEEILYHPLFYKTKRCEDYK

SEQ ID NO: 3397710 - protein, 24 aa, Plasmodium falciparum
STVKKYLFDKLNWLKSYDNKDKKK

SEQ ID NO: 3397711 - protein, 25 aa, Plasmodium falciparum
SVCNNMMIFLLQIYAPLDELGNCFH

SEQ ID NO: 3397712 - protein, 23 aa, Plasmodium falciparum
SVKAHFILGLTLLHLNSLEEGLK

SEQ ID NO: 3397713 - protein, 22 aa, Plasmodium falciparum
SVNLWDFFMNPLLLNINHADDK

SEQ ID NO: 3397714 - protein, 25 aa, Plasmodium falciparum
SVQDILYYQKLLLCLKYVGDHNSAI

SEQ ID NO: 3397715 - protein, 19 aa, Plasmodium falciparum
SVSLLLLNYALKSGFKPLY

SEQ ID NO: 3397716 - protein, 26 aa, Plasmodium falciparum
SWNKRMCAWLAFFYDGASRRSRTFHP

SEQ ID NO: 3397717 - protein, 24 aa, Plasmodium falciparum
SYELSKYLYLFYELGKMTEKLNTL

SEQ ID NO: 3397718 - protein, 22 aa, Plasmodium falciparum
SYFLPPGFLRRALFSALYKGVN

SEQ ID NO: 3397719 - protein, 17 aa, Plasmodium falciparum
SYIVVLLNRKIENLTYA

SEQ ID NO: 3397720 - protein, 22 aa, Plasmodium falciparum
SYKLYYKLLLFLNLRFDVYSNN

SEQ ID NO: 3397721 - protein, 24 aa, Plasmodium falciparum
SYMEKINMLFKILYNHSLNISTCK

SEQ ID NO: 3397722 - protein, 26 aa, Plasmodium falciparum
SYRHTYLKTIYIWYKKNKKLLFNTDD

SEQ ID NO: 3397723 - protein, 25 aa, Plasmodium falciparum
TALCKLPLDDSLLNFLKNFKKADEI

SEQ ID NO: 3397724 - protein, 26 aa, Plasmodium falciparum
TAMNSLNMLILPKIKGVRFDKSGRRW

SEQ ID NO: 3397725 - protein, 23 aa, Plasmodium falciparum
TDNYLHVFILNNGNIYGSGKKCS

SEQ ID NO: 3397726 - protein, 28 aa, Plasmodium falciparum
TEFGRNFLLKLFFFLGRYFNSKSIFMYK

SEQ ID NO: 3397727 - protein, 23 aa, Plasmodium falciparum
TFIYNHILFWTIKITFVNLNIRI

SEQ ID NO: 3397728 - protein, 18 aa, Plasmodium falciparum
TFKILFEICKLKNLSYSI

SEQ ID NO: 3397729 - protein, 27 aa, Plasmodium falciparum
TFLKWKRFRGMLKRYFFLLKNTNNNNY

SEQ ID NO: 3397730 - protein, 19 aa, Plasmodium falciparum
TFVEFILNPLYKIFGYVCS

SEQ ID NO: 3397731 - protein, 25 aa, Plasmodium falciparum
TFVPVPVRRKIIPKIKWISDVYQVD

SEQ ID NO: 3397732 - protein, 22 aa, Plasmodium falciparum
THKPYIFLFSKKNLLQYLKTKH

SEQ ID NO: 3397733 - protein, 23 aa, Plasmodium falciparum
TIDGCAIFYNKKKLKFVETYALE

SEQ ID NO: 3397734 - protein, 19 aa, Plasmodium falciparum
TILRWIDLLRSMKLKQLKK

SEQ ID NO: 3397735 - protein, 22 aa, Plasmodium falciparum
TITLPYIYKLIPLKYFGYKHKI

SEQ ID NO: 3397736 - protein, 33 aa, Plasmodium falciparum
TIYSFLDIDLLPTPLLFYLYDNFKILQTLICKN

SEQ ID NO: 3397737 - protein, 20 aa, Plasmodium falciparum
TKFKKIIRYLIQNYKIKNIN

SEQ ID NO: 3397738 - protein, 18 aa, Plasmodium falciparum
TKKKLLKKLWTKIEDMKN

SEQ ID NO: 3397739 - protein, 22 aa, Plasmodium falciparum
TKPFLFILINFIKTLLINDTIK

SEQ ID NO: 3397740 - protein, 25 aa, Plasmodium falciparum
TKPKWKPFFMKLNIYHVLALWLMPT

SEQ ID NO: 3397741 - protein, 22 aa, Plasmodium falciparum
TKYFFYIFTLDMLPSIKFETFY

SEQ ID NO: 3397742 - protein, 19 aa, Plasmodium falciparum
TKYVYCNVPWFNINVKYNI

SEQ ID NO: 3397743 - protein, 25 aa, Plasmodium falciparum
TLIETYIFLPLKYKYTYLSSLCFHY

SEQ ID NO: 3397744 - protein, 23 aa, Plasmodium falciparum
TLKPFQMVLLLYSLSKLKIYSYK

SEQ ID NO: 3397745 - protein, 28 aa, Plasmodium falciparum
TLNNYYNFHILLNILRRKQLYHNSFNQL

SEQ ID NO: 3397746 - protein, 18 aa, Plasmodium falciparum
TLYLCNFFYFSIYEITNN

SEQ ID NO: 3397747 - protein, 23 aa, Plasmodium falciparum
TNDHMIYPFYIFPIYSQLSSEQQ

SEQ ID NO: 3397748 - protein, 24 aa, Plasmodium falciparum
TNENWHLYIIFPGSPIFNQFCNNN

SEQ ID NO: 3397749 - protein, 24 aa, Plasmodium falciparum
TNHPYKLIIPKQIKPTPLLLNSQK

SEQ ID NO: 3397750 - protein, 21 aa, Plasmodium falciparum
TNIFRNFFKNLFFFNDKNKKK

SEQ ID NO: 3397751 - protein, 23 aa, Plasmodium falciparum
TNLSLHKMFYFYKNYIVYMDPYY

SEQ ID NO: 3397752 - protein, 25 aa, Plasmodium falciparum
TNTYPTIFWCPLKFNDKTRILQQNT

SEQ ID NO: 3397753 - protein, 23 aa, Plasmodium falciparum
TNYYSYFVYILKKYKNFKNLQNL

SEQ ID NO: 3397754 - protein, 21 aa, Plasmodium falciparum
TRKRLYFLKLFYVKENKTLKV

SEQ ID NO: 3397755 - protein, 21 aa, Plasmodium falciparum
TTFKLFLITLLISKGHVEFYK

SEQ ID NO: 3397756 - protein, 24 aa, Plasmodium falciparum
TTKKKIHWLPYLPQQLITCTLYEY

SEQ ID NO: 3397757 - protein, 23 aa, Plasmodium falciparum
TTSQIIYILSYFKKLAVHNGKEL

SEQ ID NO: 3397758 - protein, 24 aa, Plasmodium falciparum
TYEKGDFFYIPRFSNFQIINDSRY

SEQ ID NO: 3397759 - protein, 23 aa, Plasmodium falciparum
TYFDLKTILFYTKKYDKIKKKII

SEQ ID NO: 3397760 - protein, 21 aa, Plasmodium falciparum
TYKTVFLCYPCVYRSIEDFTK

SEQ ID NO: 3397761 - protein, 23 aa, Plasmodium falciparum
TYMDFILSYLIFNDTFFFKYIQK

SEQ ID NO: 3397762 - protein, 36 aa, Plasmodium falciparum
VATDPRLHFIKRKILFMMQLWHDSFILHQHICTAIF

SEQ ID NO: 3397763 - protein, 20 aa, Plasmodium falciparum
VCSLRIKLWEALLLYVNNLN

SEQ ID NO: 3397764 - protein, 25 aa, Plasmodium falciparum
VDKDSFFIIFEKAWKLFFHDDTKGK

SEQ ID NO: 3397765 - protein, 24 aa, Plasmodium falciparum
VDKKLIWGNVQPFLYIPSNDYMDD

SEQ ID NO: 3397766 - protein, 23 aa, Plasmodium falciparum
VDKNLFRFFLETLFYEYMTDERF

SEQ ID NO: 3397767 - protein, 17 aa, Plasmodium falciparum
VEKLFKKYILKYSFHKL

SEQ ID NO: 3397768 - protein, 26 aa, Plasmodium falciparum
VETFEYLLLLKLLFPKNITLLRGNHE

SEQ ID NO: 3397769 - protein, 17 aa, Plasmodium falciparum
VEYLKLLNKIMEGLLEH

SEQ ID NO: 3397770 - protein, 18 aa, Plasmodium falciparum
VHKLCKWLYNINDKLYFN

SEQ ID NO: 3397771 - protein, 24 aa, Plasmodium falciparum
VICLLFSLKILFPKHIYLLRGNHE

SEQ ID NO: 3397772 - protein, 25 aa, Plasmodium falciparum
VIHKYDFFLYIFFNCLHEDIWGLQG

SEQ ID NO: 3397773 - protein, 30 aa, Plasmodium falciparum
VINKGLWIYDSLFFMIIRKDGYLDFWNLLY

SEQ ID NO: 3397774 - protein, 17 aa, Plasmodium falciparum
VISKLRIIRMLLNLVLC

SEQ ID NO: 3397775 - protein, 25 aa, Plasmodium falciparum
VISKSNRLYLFNKFFTSLFYEDNTR

SEQ ID NO: 3397776 - protein, 24 aa, Plasmodium falciparum
VKDWKLFAIPFISLMKILPKGQGS

SEQ ID NO: 3397777 - protein, 23 aa, Plasmodium falciparum
VKENDMKVIWPNKLSWKEISNEI

SEQ ID NO: 3397778 - protein, 17 aa, Plasmodium falciparum
VKIYMDYDTWLFNHGKP

SEQ ID NO: 3397779 - protein, 21 aa, Plasmodium falciparum
VKREYIFKINKLKKLLHSEVD

SEQ ID NO: 3397780 - protein, 17 aa, Plasmodium falciparum
VLFKMRFIDGISTVNRH

SEQ ID NO: 3397781 - protein, 24 aa, Plasmodium falciparum
VNICKKIFLLKYYSAKDKLHFNKK

SEQ ID NO: 3397782 - protein, 25 aa, Plasmodium falciparum
VNKNYLRFLFLQLLKKRFIKKCKYF

SEQ ID NO: 3397783 - protein, 25 aa, Plasmodium falciparum
VQDVGFFLPFYRKLLKKYETINNVV

SEQ ID NO: 3397784 - protein, 20 aa, Plasmodium falciparum
VQITWLCLKLDSIPYNNYCL

SEQ ID NO: 3397785 - protein, 17 aa, Plasmodium falciparum
VQWLMDERKRRLKNNLP

SEQ ID NO: 3397786 - protein, 20 aa, Plasmodium falciparum
VRNYYDGLYPFLNNYKEEEC

SEQ ID NO: 3397787 - protein, 24 aa, Plasmodium falciparum
VRRMWHPLFNRPLGDIGRKLILKE

SEQ ID NO: 3397788 - protein, 18 aa, Plasmodium falciparum
VRSWIIKLIVKYKIKDSK

SEQ ID NO: 3397789 - protein, 23 aa, Plasmodium falciparum
VSGATWIYAPPELLTCHPLKQSS

SEQ ID NO: 3397790 - protein, 23 aa, Plasmodium falciparum
VSQKWIVRGFYRIGIFALRDIPS

SEQ ID NO: 3397791 - protein, 24 aa, Plasmodium falciparum
VSRKGLIFILTIQDVLIKKTKKIL

SEQ ID NO: 3397792 - protein, 19 aa, Plasmodium falciparum
VVWFFREYFYRLAINKNIF

SEQ ID NO: 3397793 - protein, 20 aa, Plasmodium falciparum
VYCFFEIKLTIILLNFFISN

SEQ ID NO: 3397794 - protein, 21 aa, Plasmodium falciparum
VYNFISLYKFDIEKIQLELCN

SEQ ID NO: 3397795 - protein, 24 aa, Plasmodium falciparum
WAPLWRVWIFFLRGVIPLLERWLS

SEQ ID NO: 3397796 - protein, 19 aa, Plasmodium falciparum
WHIPLFYIFEMSKLTLFLG

SEQ ID NO: 3397797 - protein, 17 aa, Plasmodium falciparum
WIILLPFVDKERIIKHA

SEQ ID NO: 3397798 - protein, 19 aa, Plasmodium falciparum
WINSNLLLFTSLNGNIYIY

SEQ ID NO: 3397799 - protein, 18 aa, Plasmodium falciparum
WKDKSILPFSFPGLLYLY

SEQ ID NO: 3397800 - protein, 25 aa, Plasmodium falciparum
WKELYIECICILRFLFFNCKLVHAD

SEQ ID NO: 3397801 - protein, 18 aa, Plasmodium falciparum
WKNTIKVPIWLKKPKDRE

SEQ ID NO: 3397802 - protein, 18 aa, Plasmodium falciparum
WLYLRRNTNIFLQNTLLI

SEQ ID NO: 3397803 - protein, 23 aa, Plasmodium falciparum
WMGYFLFYECMINTILYARDKYL

SEQ ID NO: 3397804 - protein, 18 aa, Plasmodium falciparum
WVFKVFSYEKKKLTFLSK

SEQ ID NO: 3397805 - protein, 17 aa, Plasmodium falciparum
WYHFPSTSKFRNLENVE

SEQ ID NO: 3397806 - protein, 19 aa, Plasmodium falciparum
WYLILLWLYTHNQYKCDLR

SEQ ID NO: 3397807 - protein, 21 aa, Plasmodium falciparum
WYRLNMKIFLYCWWYVEEVCF

SEQ ID NO: 3397808 - protein, 19 aa, Plasmodium falciparum
YCRNDMWTFFFKNSLFKIN

SEQ ID NO: 3397809 - protein, 24 aa, Plasmodium falciparum
YDDKKVLFLFFISGNLQNFHVTSN

SEQ ID NO: 3397810 - protein, 22 aa, Plasmodium falciparum
YDDYMYLFMKYFQLLNIKNHNE

SEQ ID NO: 3397811 - protein, 26 aa, Plasmodium falciparum
YDIVTSKLYFFDILSVQWKEYNEDTF

SEQ ID NO: 3397812 - protein, 25 aa, Plasmodium falciparum
YDKNKGFYLDITKKPLKFILNALFQ

SEQ ID NO: 3397813 - protein, 28 aa, Plasmodium falciparum
YDNNMLNYFFYIKYIISYSPWNIFKDYV

SEQ ID NO: 3397814 - protein, 24 aa, Plasmodium falciparum
YEEALAVEKLFFLSSRERCNYCNY

SEQ ID NO: 3397815 - protein, 22 aa, Plasmodium falciparum
YEIKLYYLFKLYHYFKKKEKFK

SEQ ID NO: 3397816 - protein, 20 aa, Plasmodium falciparum
YEKLVDVFTKKLPPCIHSKI

SEQ ID NO: 3397817 - protein, 24 aa, Plasmodium falciparum
YEKQKIYSILFYNSPHSYVCNEYQ

SEQ ID NO: 3397818 - protein, 22 aa, Plasmodium falciparum
YEKYIIYILSKYFWPGPLSIIA

SEQ ID NO: 3397819 - protein, 17 aa, Plasmodium falciparum
YELLLFSSLIKCNILCN

SEQ ID NO: 3397820 - protein, 22 aa, Plasmodium falciparum
YEYYYEQFLFILNKIILNISSN

SEQ ID NO: 3397821 - protein, 21 aa, Plasmodium falciparum
YFCFTMYKIYLRRILFGYLRI

SEQ ID NO: 3397822 - protein, 19 aa, Plasmodium falciparum
YFDDLNNIYFLLEDFTNTY

SEQ ID NO: 3397823 - protein, 19 aa, Plasmodium falciparum
YFFYTFYFELFINSYLYNR

SEQ ID NO: 3397824 - protein, 17 aa, Plasmodium falciparum
YFIFYDGSNIHISPLNQ

SEQ ID NO: 3397825 - protein, 21 aa, Plasmodium falciparum
YFKNLFKNLNRKIEYTFACEK

SEQ ID NO: 3397826 - protein, 20 aa, Plasmodium falciparum
YFLKNFLHKILPYFFKELQF

SEQ ID NO: 3397827 - protein, 17 aa, Plasmodium falciparum
YFLKYFYCIYKDNNYIM

SEQ ID NO: 3397828 - protein, 23 aa, Plasmodium falciparum
YFNKLLFVWSYIDLLEIILKECL

SEQ ID NO: 3397829 - protein, 19 aa, Plasmodium falciparum
YFRQYNILRFTYFKLLKQV

SEQ ID NO: 3397830 - protein, 19 aa, Plasmodium falciparum
YFVYLFLKNLPQKELMNFR

SEQ ID NO: 3397831 - protein, 17 aa, Plasmodium falciparum
YFYDFWYNFNNWRDFSY

SEQ ID NO: 3397832 - protein, 22 aa, Plasmodium falciparum
YGKFYSFLPHVLLKKIILENYI

SEQ ID NO: 3397833 - protein, 18 aa, Plasmodium falciparum
YGLLIFKHYKYILPYKHI

SEQ ID NO: 3397834 - protein, 24 aa, Plasmodium falciparum
YGYVVEVFFPKTYPKVFVRFDNLQ

SEQ ID NO: 3397835 - protein, 17 aa, Plasmodium falciparum
YHISLFFFCKYTSYNLY

SEQ ID NO: 3397836 - protein, 25 aa, Plasmodium falciparum
YIDKETFLQFFPLPGLWGERLFLKF

SEQ ID NO: 3397837 - protein, 20 aa, Plasmodium falciparum
YIFIFILLTNKFLKTFDYVE

SEQ ID NO: 3397838 - protein, 25 aa, Plasmodium falciparum
YIFSIKFFFLYYYIKIPVYEKVRNI

SEQ ID NO: 3397839 - protein, 17 aa, Plasmodium falciparum
YIGFTIIHLNYLYELQK

SEQ ID NO: 3397840 - protein, 18 aa, Plasmodium falciparum
YIILINIADYRKSYYKID

SEQ ID NO: 3397841 - protein, 20 aa, Plasmodium falciparum
YIIRVYLLLLLLSKSKLLLI

SEQ ID NO: 3397842 - protein, 17 aa, Plasmodium falciparum
YIKLWDLRFLKDSFFTT

SEQ ID NO: 3397843 - protein, 18 aa, Plasmodium falciparum
YILEYFLKKYFNSFLLIQ

SEQ ID NO: 3397844 - protein, 17 aa, Plasmodium falciparum
YILLFQNEIVDIIIEDI

SEQ ID NO: 3397845 - protein, 26 aa, Plasmodium falciparum
YINDFLIYIEKYIYSLNFYLPTQNFN

SEQ ID NO: 3397846 - protein, 25 aa, Plasmodium falciparum
YINIKYFFLFILDVSNDYIIYENFL

SEQ ID NO: 3397847 - protein, 17 aa, Plasmodium falciparum
YIPEYLLNIKKKIKLIL

SEQ ID NO: 3397848 - protein, 20 aa, Plasmodium falciparum
YIPIKKFNYSYLFIEKKKKN

SEQ ID NO: 3397849 - protein, 21 aa, Plasmodium falciparum
YIQRCILPTDLPYAELYVLID

SEQ ID NO: 3397850 - protein, 19 aa, Plasmodium falciparum
YISLPSYLRYIPVACPYFI

SEQ ID NO: 3397851 - protein, 18 aa, Plasmodium falciparum
YISYMQKALIKASEGNFL

SEQ ID NO: 3397852 - protein, 18 aa, Plasmodium falciparum
YKDFRYEYIFKTKIAYML

SEQ ID NO: 3397853 - protein, 18 aa, Plasmodium falciparum
YKDVIYSEFFRLSSKRKK

SEQ ID NO: 3397854 - protein, 19 aa, Plasmodium falciparum
YKFTPLLPSYYFKVLKNKI

SEQ ID NO: 3397855 - protein, 25 aa, Plasmodium falciparum
YKKKDILLSLWWKNLIDLYSDIIIT

SEQ ID NO: 3397856 - protein, 17 aa, Plasmodium falciparum
YKRLYYIMKDYIYNILK

SEQ ID NO: 3397857 - protein, 18 aa, Plasmodium falciparum
YKRMYQSFILLKKEYRDL

SEQ ID NO: 3397858 - protein, 20 aa, Plasmodium falciparum
YKSIKQFLKKYYVYNDIYID

SEQ ID NO: 3397859 - protein, 19 aa, Plasmodium falciparum
YKVLSIIKHLLFFRTNEEK

SEQ ID NO: 3397860 - protein, 18 aa, Plasmodium falciparum
YLALIPKLEYINGAVKLL

SEQ ID NO: 3397861 - protein, 17 aa, Plasmodium falciparum
YLIVTLRSLVRVIKPEQ

SEQ ID NO: 3397862 - protein, 17 aa, Plasmodium falciparum
YLLLLLLSKSKLLLIDE

SEQ ID NO: 3397863 - protein, 24 aa, Plasmodium falciparum
YLPPTLSIKIWKLAFCSSIHGVSF

SEQ ID NO: 3397864 - protein, 17 aa, Plasmodium falciparum
YMFALTFNKKVFNDRKH

SEQ ID NO: 3397865 - protein, 24 aa, Plasmodium falciparum
YMHTNFIIFQGLLSNIILLQKNTK

SEQ ID NO: 3397866 - protein, 25 aa, Plasmodium falciparum
YMKRKNWIFLPICLKLSKTKDEDVS

SEQ ID NO: 3397867 - protein, 20 aa, Plasmodium falciparum
YMLKKFLLGFKFINLNEISI

SEQ ID NO: 3397868 - protein, 28 aa, Plasmodium falciparum
YMLNEFLKKLYIYQIYILKKIVFNKSDI

SEQ ID NO: 3397869 - protein, 17 aa, Plasmodium falciparum
YMNLILYSKIDLIKMYK

SEQ ID NO: 3397870 - protein, 26 aa, Plasmodium falciparum
YMRKKKLLFFYFYQDLKNPNYLLNKR

SEQ ID NO: 3397871 - protein, 24 aa, Plasmodium falciparum
YNDSKFLLYFLLNEEEIYKKLFEK

SEQ ID NO: 3397872 - protein, 23 aa, Plasmodium falciparum
YNDTCPYLLYVPRQGYFCSHHIG

SEQ ID NO: 3397873 - protein, 21 aa, Plasmodium falciparum
YNFLIFFDIKYFLIFKDIIND

SEQ ID NO: 3397874 - protein, 24 aa, Plasmodium falciparum
YNFSCKFLLLHFLLKNIKQNTNDK

SEQ ID NO: 3397875 - protein, 17 aa, Plasmodium falciparum
YNKIRARIFSNFNKKQK

SEQ ID NO: 3397876 - protein, 32 aa, Plasmodium falciparum
YNMMNDFYNYFPFNYYYYNMNNLYFNNSNYNN

SEQ ID NO: 3397877 - protein, 20 aa, Plasmodium falciparum
YNMVFLPYHFLLTSIGEFGE

SEQ ID NO: 3397878 - protein, 17 aa, Plasmodium falciparum
YNQKFYILLKENIFLFL

SEQ ID NO: 3397879 - protein, 24 aa, Plasmodium falciparum
YNREYFLRQLLLKQAFNDLYNFSQ

SEQ ID NO: 3397880 - protein, 18 aa, Plasmodium falciparum
YNRKLLLNFLLKLHYLKY

SEQ ID NO: 3397881 - protein, 25 aa, Plasmodium falciparum
YNSLKINLFFLFDDMYDKFFIENYQ

SEQ ID NO: 3397882 - protein, 22 aa, Plasmodium falciparum
YNTKQFLLLIDPFFKIICMTDQ

SEQ ID NO: 3397883 - protein, 19 aa, Plasmodium falciparum
YNWLYHRTALFEPMDISYA

SEQ ID NO: 3397884 - protein, 22 aa, Plasmodium falciparum
YNYKFMIYTFFKWLLENPFIYK

SEQ ID NO: 3397885 - protein, 21 aa, Plasmodium falciparum
YPKIILYNKPLIRRGAILLKK

SEQ ID NO: 3397886 - protein, 19 aa, Plasmodium falciparum
YPTVYTLWKFPKMIPCFVI

SEQ ID NO: 3397887 - protein, 17 aa, Plasmodium falciparum
YQVNIPNKCQLNKFPSG

SEQ ID NO: 3397888 - protein, 17 aa, Plasmodium falciparum
YRCILILKYIKLEDYKN

SEQ ID NO: 3397889 - protein, 19 aa, Plasmodium falciparum
YRKLSILIHPDKCKIDKAA

SEQ ID NO: 3397890 - protein, 26 aa, Plasmodium falciparum
YSEQDIIKLIYYFMENFIFKKKKENR

SEQ ID NO: 3397891 - protein, 24 aa, Plasmodium falciparum
YSIPLFFRIIFLSCYFEFLNNEEN

SEQ ID NO: 3397892 - protein, 27 aa, Plasmodium falciparum
YSKPVIIVLPLFKLIYVPLYDPLKQNE

SEQ ID NO: 3397893 - protein, 25 aa, Plasmodium falciparum
YSPTDLTIIYYYLKKFQLLTNKKKH

SEQ ID NO: 3397894 - protein, 20 aa, Plasmodium falciparum
YTCYNISTIPWFGYKNWGVL

SEQ ID NO: 3397895 - protein, 23 aa, Plasmodium falciparum
YTKEDYPLLPRLVTNFISAVELY

SEQ ID NO: 3397896 - protein, 18 aa, Plasmodium falciparum
YTNSFWSYIFGYFNNIYN

SEQ ID NO: 3397897 - protein, 22 aa, Plasmodium falciparum
YTNYEIKMFLLNTIKAIGIVFK

SEQ ID NO: 3397898 - protein, 29 aa, Plasmodium falciparum
YTSGQKYYLFRRKVLLIFQSDLKDIQKSQ

SEQ ID NO: 3397899 - protein, 21 aa, Plasmodium falciparum
YTYHTLPFTTYPWENNYNMYN

SEQ ID NO: 3397900 - protein, 19 aa, Plasmodium falciparum
YVGNLPWKVTWPILKNHMK

SEQ ID NO: 3397901 - protein, 19 aa, Plasmodium falciparum
YVINRMLYLALPPHIFVST

SEQ ID NO: 3397902 - protein, 18 aa, Plasmodium falciparum
YVIPYYYNNRHNINSSTS

SEQ ID NO: 3397903 - protein, 21 aa, Plasmodium falciparum
YVNVLYFRKLKLNKKLFEKLK

SEQ ID NO: 3397904 - protein, 18 aa, Plasmodium falciparum
YVRKFVLSVFRFLTNSID

SEQ ID NO: 3397905 - protein, 17 aa, Plasmodium falciparum
YYCIRYCSIFSFVLNKI

SEQ ID NO: 3397906 - protein, 20 aa, Plasmodium falciparum
YYCNQYLNEYPLFPVSSIDL

SEQ ID NO: 3397907 - protein, 17 aa, Plasmodium falciparum
YYFLFYKNSYEYNIYDR

SEQ ID NO: 3397908 - protein, 22 aa, Plasmodium falciparum
YYGSLCFLPYKKSLFVFGGTDN

SEQ ID NO: 3397909 - protein, 19 aa, Plasmodium falciparum
YYIIILFKLNDNFIFNKLI

SEQ ID NO: 3397910 - protein, 18 aa, Plasmodium falciparum
YYNYYCSGLIPTYPIFNY

SEQ ID NO: 3397911 - protein, 19 aa, Plasmodium falciparum
YYWHVFHHYKFFFVKYIYM

SEQ ID NO: 3397912 - protein, 6 aa, Plasmodium falciparum
PTHEES

SEQ ID NO: 3397913 - protein, 12 aa, Plasmodium falciparum
QNIHTEHDLKIF

SEQ ID NO: 3397914 - protein, 5 aa, Plasmodium falciparum
SIDDP

SEQ ID NO: 3397915 - protein, 4 aa, Plasmodium falciparum
TDGS

SEQ ID NO: 3397916 - protein, 11 aa, Plasmodium falciparum
TDPSDGEENNS

SEQ ID NO: 3397917 - protein, 32 aa, Plasmodium falciparum
GNKNPQKRERKNEEENQKDNTKVDNDNNMENE

SEQ ID NO: 3397918 - protein, 7 aa, Plasmodium falciparum
ATDTLPK

SEQ ID NO: 3397919 - protein, 4 aa, Plasmodium falciparum
EDQK

SEQ ID NO: 3397920 - protein, 7 aa, Plasmodium falciparum
KNAFTDD

SEQ ID NO: 3397921 - protein, 8 aa, Plasmodium falciparum
NNAPTNVI

SEQ ID NO: 3397922 - protein, 4 aa, Plasmodium falciparum
NNDN

SEQ ID NO: 3397923 - protein, 7 aa, Plasmodium falciparum
NNTSNSL

SEQ ID NO: 3397924 - protein, 10 aa, Plasmodium falciparum
PEDKNEKGQH

SEQ ID NO: 3397925 - protein, 6 aa, Plasmodium falciparum
AQEKKK

SEQ ID NO: 3397926 - protein, 8 aa, Plasmodium falciparum
ATRDNKVN

SEQ ID NO: 3397927 - protein, 4 aa, Plasmodium falciparum
CEKC

SEQ ID NO: 3397928 - protein, 6 aa, Plasmodium falciparum
DDSMDG

SEQ ID NO: 3397929 - protein, 15 aa, Plasmodium falciparum
DDTLINEKKKKKTAP

SEQ ID NO: 3397930 - protein, 6 aa, Plasmodium falciparum
DKTPDH

SEQ ID NO: 3397931 - protein, 4 aa, Plasmodium falciparum
DNIN

SEQ ID NO: 3397932 - protein, 6 aa, Plasmodium falciparum
DPFEPQ

SEQ ID NO: 3397933 - protein, 6 aa, Plasmodium falciparum
DSMDGP

SEQ ID NO: 3397934 - protein, 4 aa, Plasmodium falciparum
EEVT

SEQ ID NO: 3397935 - protein, 4 aa, Plasmodium falciparum
ENEE

SEQ ID NO: 3397936 - protein, 7 aa, Plasmodium falciparum
ENIPTHE

SEQ ID NO: 3397937 - protein, 4 aa, Plasmodium falciparum
GDNI

SEQ ID NO: 3397938 - protein, 8 aa, Plasmodium falciparum
GGKLSPDI

SEQ ID NO: 3397939 - protein, 9 aa, Plasmodium falciparum
GLSKEEVQK

SEQ ID NO: 3397940 - protein, 10 aa, Plasmodium falciparum
HATTPTNEPI

SEQ ID NO: 3397941 - protein, 5 aa, Plasmodium falciparum
IPQKT

SEQ ID NO: 3397942 - protein, 4 aa, Plasmodium falciparum
KDIE

SEQ ID NO: 3397943 - protein, 6 aa, Plasmodium falciparum
KDKVNP

SEQ ID NO: 3397944 - protein, 9 aa, Plasmodium falciparum
KGANENESS

SEQ ID NO: 3397945 - protein, 5 aa, Plasmodium falciparum
KKKNS

SEQ ID NO: 3397946 - protein, 6 aa, Plasmodium falciparum
KKKTRN

SEQ ID NO: 3397947 - protein, 11 aa, Plasmodium falciparum
KKMPGKHGNKY

SEQ ID NO: 3397948 - protein, 6 aa, Plasmodium falciparum
KKYNEL

SEQ ID NO: 3397949 - protein, 4 aa, Plasmodium falciparum
KKYT

SEQ ID NO: 3397950 - protein, 7 aa, Plasmodium falciparum
KNEDPDF

SEQ ID NO: 3397951 - protein, 6 aa, Plasmodium falciparum
KNKEIN

SEQ ID NO: 3397952 - protein, 5 aa, Plasmodium falciparum
KPLDE

SEQ ID NO: 3397953 - protein, 8 aa, Plasmodium falciparum
KSDHNGPF

SEQ ID NO: 3397954 - protein, 13 aa, Plasmodium falciparum
KSEMSDQYTKESL

SEQ ID NO: 3397955 - protein, 15 aa, Plasmodium falciparum
KVAEEVDQKVDEEVT

SEQ ID NO: 3397956 - protein, 26 aa, Plasmodium falciparum
LNKEENNNDKKNKSSGNSTSVKGNDL

SEQ ID NO: 3397957 - protein, 5 aa, Plasmodium falciparum
LSKGK

SEQ ID NO: 3397958 - protein, 6 aa, Plasmodium falciparum
LTESTG

SEQ ID NO: 3397959 - protein, 4 aa, Plasmodium falciparum
NEKE

SEQ ID NO: 3397960 - protein, 7 aa, Plasmodium falciparum
NLPSPKR

SEQ ID NO: 3397961 - protein, 8 aa, Plasmodium falciparum
NNKGEKKS

SEQ ID NO: 3397962 - protein, 4 aa, Plasmodium falciparum
NNNN

SEQ ID NO: 3397963 - protein, 4 aa, Plasmodium falciparum
NTRR

SEQ ID NO: 3397964 - protein, 9 aa, Plasmodium falciparum
PEDKNEKVE

SEQ ID NO: 3397965 - protein, 9 aa, Plasmodium falciparum
PEDKNEKVQ

SEQ ID NO: 3397966 - protein, 5 aa, Plasmodium falciparum
PGNRN

SEQ ID NO: 3397967 - protein, 7 aa, Plasmodium falciparum
PIAPNTK

SEQ ID NO: 3397968 - protein, 18 aa, Plasmodium falciparum
PMSHGSSHHRKPGSIGAS

SEQ ID NO: 3397969 - protein, 21 aa, Plasmodium falciparum
PNIKDNYDINEKKKNLEEQNK

SEQ ID NO: 3397970 - protein, 4 aa, Plasmodium falciparum
QPLS

SEQ ID NO: 3397971 - protein, 4 aa, Plasmodium falciparum
SDEL

SEQ ID NO: 3397972 - protein, 9 aa, Plasmodium falciparum
SGTSGKPKG

SEQ ID NO: 3397973 - protein, 10 aa, Plasmodium falciparum
SGTSGKPKGV

SEQ ID NO: 3397974 - protein, 5 aa, Plasmodium falciparum
SGVGK

SEQ ID NO: 3397975 - protein, 4 aa, Plasmodium falciparum
SIPN

SEQ ID NO: 3397976 - protein, 4 aa, Plasmodium falciparum
SPQG

SEQ ID NO: 3397977 - protein, 7 aa, Plasmodium falciparum
TKTQTKK

SEQ ID NO: 3397978 - protein, 9 aa, Plasmodium falciparum
VDKDSREQF

SEQ ID NO: 3397979 - protein, 6 aa, Plasmodium falciparum
VNNDLK

SEQ ID NO: 3397980 - protein, 11 aa, Plasmodium falciparum
VSPPRNNISPP

SEQ ID NO: 3397981 - protein, 17 aa, Plasmodium falciparum
YEGKGIESKKYNEKQNN

SEQ ID NO: 3397982 - protein, 20 aa, Plasmodium falciparum
YEPTQNEDNNTKKLKTEREY

SEQ ID NO: 3397983 - protein, 6 aa, Plasmodium falciparum
YGEPQN

SEQ ID NO: 3397984 - protein, 8 aa, Plasmodium falciparum
AADKGDNI

SEQ ID NO: 3397985 - protein, 8 aa, Plasmodium falciparum
AAKKNYAD

SEQ ID NO: 3397986 - protein, 5 aa, Plasmodium falciparum
AAKRA

SEQ ID NO: 3397987 - protein, 10 aa, Plasmodium falciparum
AANKYKSPKV

SEQ ID NO: 3397988 - protein, 11 aa, Plasmodium falciparum
AANNNMNNAPT

SEQ ID NO: 3397989 - protein, 37 aa, Plasmodium falciparum
AATPYAGEPAPFDETLGEEDKDLDEPEQFRLPEENEW

SEQ ID NO: 3397990 - protein, 4 aa, Plasmodium falciparum
AATR

SEQ ID NO: 3397991 - protein, 8 aa, Plasmodium falciparum
ACKAPDDY

SEQ ID NO: 3397992 - protein, 6 aa, Plasmodium falciparum
ADDEYS

SEQ ID NO: 3397993 - protein, 5 aa, Plasmodium falciparum
ADEKY

SEQ ID NO: 3397994 - protein, 4 aa, Plasmodium falciparum
ADIN

SEQ ID NO: 3397995 - protein, 10 aa, Plasmodium falciparum
ADIYNDNNYK

SEQ ID NO: 3397996 - protein, 7 aa, Plasmodium falciparum
ADKDERG

SEQ ID NO: 3397997 - protein, 9 aa, Plasmodium falciparum
ADKNSDLGK

SEQ ID NO: 3397998 - protein, 87 aa, Plasmodium falciparum
ADMNSKKNKSKNPQKLNNTQGDKNVNDDENVNDDENVKGDENVKGDENVKGDEYMKGDENVKGDENVKDDENVKDDENIKGDDNNYN

SEQ ID NO: 3397999 - protein, 6 aa, Plasmodium falciparum
ADNNLE

SEQ ID NO: 3398000 - protein, 12 aa, Plasmodium falciparum
ADQGDTTSALST

SEQ ID NO: 3398001 - protein, 6 aa, Plasmodium falciparum
ADQKHS

SEQ ID NO: 3398002 - protein, 6 aa, Plasmodium falciparum
ADVEGN

SEQ ID NO: 3398003 - protein, 5 aa, Plasmodium falciparum
AEAYR

SEQ ID NO: 3398004 - protein, 4 aa, Plasmodium falciparum
AEHN

SEQ ID NO: 3398005 - protein, 5 aa, Plasmodium falciparum
AENTR

SEQ ID NO: 3398006 - protein, 20 aa, Plasmodium falciparum
AEQKKNKLNIKKKKKKKKNR

SEQ ID NO: 3398007 - protein, 16 aa, Plasmodium falciparum
AESNKPNDNTTTSNDK

SEQ ID NO: 3398008 - protein, 4 aa, Plasmodium falciparum
AFEK

SEQ ID NO: 3398009 - protein, 8 aa, Plasmodium falciparum
AGDKTDLS

SEQ ID NO: 3398010 - protein, 8 aa, Plasmodium falciparum
AGETSKAY

SEQ ID NO: 3398011 - protein, 8 aa, Plasmodium falciparum
AGFGDNGR

SEQ ID NO: 3398012 - protein, 14 aa, Plasmodium falciparum
AGGGGAGASGGRAG

SEQ ID NO: 3398013 - protein, 11 aa, Plasmodium falciparum
AGGKHNDLDDV

SEQ ID NO: 3398014 - protein, 21 aa, Plasmodium falciparum
AGKIEKSLKSEPIPEDDKNAP

SEQ ID NO: 3398015 - protein, 8 aa, Plasmodium falciparum
AGKNTNGS

SEQ ID NO: 3398016 - protein, 12 aa, Plasmodium falciparum
AGPLKSRAATAI

SEQ ID NO: 3398017 - protein, 6 aa, Plasmodium falciparum
AHEEEK

SEQ ID NO: 3398018 - protein, 15 aa, Plasmodium falciparum
AHGKVNRSKKYSDGE

SEQ ID NO: 3398019 - protein, 6 aa, Plasmodium falciparum
AHHATD

SEQ ID NO: 3398020 - protein, 11 aa, Plasmodium falciparum
AHSNKIPNDNH

SEQ ID NO: 3398021 - protein, 12 aa, Plasmodium falciparum
AIEEQKNKALSK

SEQ ID NO: 3398022 - protein, 6 aa, Plasmodium falciparum
AIEPSS

SEQ ID NO: 3398023 - protein, 18 aa, Plasmodium falciparum
AIHSTQNNSLNNQNKADT

SEQ ID NO: 3398024 - protein, 19 aa, Plasmodium falciparum
AINNKDKDKDIPSNNDDNN

SEQ ID NO: 3398025 - protein, 10 aa, Plasmodium falciparum
AINTKNGERI

SEQ ID NO: 3398026 - protein, 6 aa, Plasmodium falciparum
AIPQEP

SEQ ID NO: 3398027 - protein, 4 aa, Plasmodium falciparum
AIQK

SEQ ID NO: 3398028 - protein, 15 aa, Plasmodium falciparum
AITSNQKEGSINDAV

SEQ ID NO: 3398029 - protein, 7 aa, Plasmodium falciparum
AKADEKN

SEQ ID NO: 3398030 - protein, 13 aa, Plasmodium falciparum
AKDMNPDENYNDI

SEQ ID NO: 3398031 - protein, 4 aa, Plasmodium falciparum
AKDV

SEQ ID NO: 3398032 - protein, 8 aa, Plasmodium falciparum
AKDVEPFS

SEQ ID NO: 3398033 - protein, 7 aa, Plasmodium falciparum
AKEASSY

SEQ ID NO: 3398034 - protein, 9 aa, Plasmodium falciparum
AKEKSSIAK

SEQ ID NO: 3398035 - protein, 26 aa, Plasmodium falciparum
AKENRRKKKKKKLEKQKLEEEKKKKK

SEQ ID NO: 3398036 - protein, 5 aa, Plasmodium falciparum
AKEVQ

SEQ ID NO: 3398037 - protein, 19 aa, Plasmodium falciparum
AKGNRNHISNNNSVDKKNE

SEQ ID NO: 3398038 - protein, 7 aa, Plasmodium falciparum
AKGVGKS

SEQ ID NO: 3398039 - protein, 9 aa, Plasmodium falciparum
AKKKKKKSI

SEQ ID NO: 3398040 - protein, 14 aa, Plasmodium falciparum
AKKKSEEYDKDDEE

SEQ ID NO: 3398041 - protein, 4 aa, Plasmodium falciparum
AKND

SEQ ID NO: 3398042 - protein, 8 aa, Plasmodium falciparum
AKNDNENE

SEQ ID NO: 3398043 - protein, 5 aa, Plasmodium falciparum
AKNNI

SEQ ID NO: 3398044 - protein, 8 aa, Plasmodium falciparum
AKNSSRNI

SEQ ID NO: 3398045 - protein, 6 aa, Plasmodium falciparum
AKPDDN

SEQ ID NO: 3398046 - protein, 8 aa, Plasmodium falciparum
AKRKGRDS

SEQ ID NO: 3398047 - protein, 5 aa, Plasmodium falciparum
AKRKI

SEQ ID NO: 3398048 - protein, 9 aa, Plasmodium falciparum
AKRRGKSRL

SEQ ID NO: 3398049 - protein, 4 aa, Plasmodium falciparum
AKSN

SEQ ID NO: 3398050 - protein, 10 aa, Plasmodium falciparum
AKSYDNPGLT

SEQ ID NO: 3398051 - protein, 6 aa, Plasmodium falciparum
AKTSEA

SEQ ID NO: 3398052 - protein, 4 aa, Plasmodium falciparum
AKYF

SEQ ID NO: 3398053 - protein, 9 aa, Plasmodium falciparum
ALASGDGRE

SEQ ID NO: 3398054 - protein, 6 aa, Plasmodium falciparum
ALNNEK

SEQ ID NO: 3398055 - protein, 5 aa, Plasmodium falciparum
ALPSV

SEQ ID NO: 3398056 - protein, 12 aa, Plasmodium falciparum
ALQKKTKNYKKK

SEQ ID NO: 3398057 - protein, 5 aa, Plasmodium falciparum
ALQSK

SEQ ID NO: 3398058 - protein, 7 aa, Plasmodium falciparum
ALSNQGG

SEQ ID NO: 3398059 - protein, 12 aa, Plasmodium falciparum
ALYQSSSKIPMS

SEQ ID NO: 3398060 - protein, 72 aa, Plasmodium falciparum
ANANVKANANVKENANVKENANVKANANVKANANVKANANVKENANVKENANVKENANVKANANVNDNANSV

SEQ ID NO: 3398061 - protein, 6 aa, Plasmodium falciparum
ANEQNE

SEQ ID NO: 3398062 - protein, 7 aa, Plasmodium falciparum
ANEQNQS

SEQ ID NO: 3398063 - protein, 4 aa, Plasmodium falciparum
ANFP

SEQ ID NO: 3398064 - protein, 4 aa, Plasmodium falciparum
ANIY

SEQ ID NO: 3398065 - protein, 7 aa, Plasmodium falciparum
ANLGDDI

SEQ ID NO: 3398066 - protein, 4 aa, Plasmodium falciparum
ANNE

SEQ ID NO: 3398067 - protein, 6 aa, Plasmodium falciparum
ANNKQH

SEQ ID NO: 3398068 - protein, 7 aa, Plasmodium falciparum
ANNNGSF

SEQ ID NO: 3398069 - protein, 4 aa, Plasmodium falciparum
ANPS

SEQ ID NO: 3398070 - protein, 37 aa, Plasmodium falciparum
ANTHNNNNNSSISSNNSSSYGNAEETEATVDYTKSPN

SEQ ID NO: 3398071 - protein, 7 aa, Plasmodium falciparum
APENYKK

SEQ ID NO: 3398072 - protein, 11 aa, Plasmodium falciparum
APEPNGKGLTN

SEQ ID NO: 3398073 - protein, 11 aa, Plasmodium falciparum
APGHAKENNLK

SEQ ID NO: 3398074 - protein, 6 aa, Plasmodium falciparum
APGTNI

SEQ ID NO: 3398075 - protein, 5 aa, Plasmodium falciparum
APKTV

SEQ ID NO: 3398076 - protein, 7 aa, Plasmodium falciparum
APPSPIF

SEQ ID NO: 3398077 - protein, 13 aa, Plasmodium falciparum
APSSTYEGPCSGE

SEQ ID NO: 3398078 - protein, 21 aa, Plasmodium falciparum
AQDEPPTDNVESQAENNKKTE

SEQ ID NO: 3398079 - protein, 8 aa, Plasmodium falciparum
AQEKGDDH

SEQ ID NO: 3398080 - protein, 7 aa, Plasmodium falciparum
AQKDSYN

SEQ ID NO: 3398081 - protein, 16 aa, Plasmodium falciparum
AQKENTVSGDGDKRGK

SEQ ID NO: 3398082 - protein, 9 aa, Plasmodium falciparum
AQKNSEKNV

SEQ ID NO: 3398083 - protein, 4 aa, Plasmodium falciparum
AQNG

SEQ ID NO: 3398084 - protein, 5 aa, Plasmodium falciparum
AQPPV

SEQ ID NO: 3398085 - protein, 12 aa, Plasmodium falciparum
AQRQATKDAGTI

SEQ ID NO: 3398086 - protein, 5 aa, Plasmodium falciparum
ARDKE

SEQ ID NO: 3398087 - protein, 4 aa, Plasmodium falciparum
AREK

SEQ ID NO: 3398088 - protein, 16 aa, Plasmodium falciparum
ARGKYIKQSGGRGQYG

SEQ ID NO: 3398089 - protein, 4 aa, Plasmodium falciparum
ARRK

SEQ ID NO: 3398090 - protein, 11 aa, Plasmodium falciparum
ARVGGTDSNSI

SEQ ID NO: 3398091 - protein, 4 aa, Plasmodium falciparum
ASAG

SEQ ID NO: 3398092 - protein, 8 aa, Plasmodium falciparum
ASAKSKYN

SEQ ID NO: 3398093 - protein, 4 aa, Plasmodium falciparum
ASDK

SEQ ID NO: 3398094 - protein, 67 aa, Plasmodium falciparum
ASHIEEPQKTESTDAQSNITQNEEINNTKPLQENITNNQQNSNEQQNNNEQQNNIEQQNNNIQQNNI

SEQ ID NO: 3398095 - protein, 7 aa, Plasmodium falciparum
ASKEDDY

SEQ ID NO: 3398096 - protein, 22 aa, Plasmodium falciparum
ASKGSKGYSKKMTKTSSRSRQC

SEQ ID NO: 3398097 - protein, 69 aa, Plasmodium falciparum
ASKVTQKSDETKADEKAEQNAEANASSSASSEEQSSSLQNTNDQSFGNTNNPKMDRKNADEQKRDAGLS

SEQ ID NO: 3398098 - protein, 5 aa, Plasmodium falciparum
ASLEE

SEQ ID NO: 3398099 - protein, 11 aa, Plasmodium falciparum
ASLPTGTENKQ

SEQ ID NO: 3398100 - protein, 4 aa, Plasmodium falciparum
ASPD

SEQ ID NO: 3398101 - protein, 13 aa, Plasmodium falciparum
ASPGNDNNNVNND

SEQ ID NO: 3398102 - protein, 5 aa, Plasmodium falciparum
ASPIQ

SEQ ID NO: 3398103 - protein, 5 aa, Plasmodium falciparum
ASPSM

SEQ ID NO: 3398104 - protein, 61 aa, Plasmodium falciparum
ASPSVVKTSTPSGTQTSGLKSSSPSSTKSSSPSNVKSASPHGESNSSEESTTKSSKRSASV

SEQ ID NO: 3398105 - protein, 4 aa, Plasmodium falciparum
ASQD

SEQ ID NO: 3398106 - protein, 11 aa, Plasmodium falciparum
ASQSAVSSTPV

SEQ ID NO: 3398107 - protein, 4 aa, Plasmodium falciparum
ASRQ

SEQ ID NO: 3398108 - protein, 6 aa, Plasmodium falciparum
ASSGEG

SEQ ID NO: 3398109 - protein, 73 aa, Plasmodium falciparum
ASTTQGGDTDTHPGTPPGEGSDVSQGAGQDASQGAGQDANPDPTLPKPPSPPADDTKDTGSQGDADSSSSKIE

SEQ ID NO: 3398110 - protein, 10 aa, Plasmodium falciparum
ASTTTHATYK

SEQ ID NO: 3398111 - protein, 14 aa, Plasmodium falciparum
ASVDHSNDKEYELS

SEQ ID NO: 3398112 - protein, 21 aa, Plasmodium falciparum
ASVEKPLTHTRNKYSNEPITN

SEQ ID NO: 3398113 - protein, 8 aa, Plasmodium falciparum
ASYEPSRR

SEQ ID NO: 3398114 - protein, 6 aa, Plasmodium falciparum
ASYNTK

SEQ ID NO: 3398115 - protein, 6 aa, Plasmodium falciparum
ATASQD

SEQ ID NO: 3398116 - protein, 7 aa, Plasmodium falciparum
ATDALPK

SEQ ID NO: 3398117 - protein, 63 aa, Plasmodium falciparum
ATDDSGNDNINNNDNFNNNDNYNDNDNFNEEPPSDDGNKNEDELTEGNQSDDKPMNEEEATIN

SEQ ID NO: 3398118 - protein, 11 aa, Plasmodium falciparum
ATGMKDPEKPI

SEQ ID NO: 3398119 - protein, 10 aa, Plasmodium falciparum
ATIGTNQNGY

SEQ ID NO: 3398120 - protein, 23 aa, Plasmodium falciparum
ATKGNQKEETEKKENHENNNAIN

SEQ ID NO: 3398121 - protein, 8 aa, Plasmodium falciparum
ATNDEHVN

SEQ ID NO: 3398122 - protein, 4 aa, Plasmodium falciparum
ATNL

SEQ ID NO: 3398123 - protein, 7 aa, Plasmodium falciparum
ATNSISS

SEQ ID NO: 3398124 - protein, 6 aa, Plasmodium falciparum
ATNTPI

SEQ ID NO: 3398125 - protein, 6 aa, Plasmodium falciparum
ATPTNE

SEQ ID NO: 3398126 - protein, 7 aa, Plasmodium falciparum
ATPTNEP

SEQ ID NO: 3398127 - protein, 8 aa, Plasmodium falciparum
ATPTNEPI

SEQ ID NO: 3398128 - protein, 7 aa, Plasmodium falciparum
ATSENAL

SEQ ID NO: 3398129 - protein, 8 aa, Plasmodium falciparum
ATSGNTIG

SEQ ID NO: 3398130 - protein, 7 aa, Plasmodium falciparum
ATSKDKH

SEQ ID NO: 3398131 - protein, 9 aa, Plasmodium falciparum
ATSNPPVPL

SEQ ID NO: 3398132 - protein, 6 aa, Plasmodium falciparum
ATTHKP

SEQ ID NO: 3398133 - protein, 18 aa, Plasmodium falciparum
ATTIQKDPNNDKEENNKN

SEQ ID NO: 3398134 - protein, 9 aa, Plasmodium falciparum
ATTPTNEPI

SEQ ID NO: 3398135 - protein, 9 aa, Plasmodium falciparum
AVENHTESK

SEQ ID NO: 3398136 - protein, 22 aa, Plasmodium falciparum
AVNENTKDVKDSCNYSTPSSVF

SEQ ID NO: 3398137 - protein, 6 aa, Plasmodium falciparum
AVPQLP

SEQ ID NO: 3398138 - protein, 10 aa, Plasmodium falciparum
AVPQNSGSNF

SEQ ID NO: 3398139 - protein, 4 aa, Plasmodium falciparum
AVTN

SEQ ID NO: 3398140 - protein, 12 aa, Plasmodium falciparum
AYDNKENLTSWP

SEQ ID NO: 3398141 - protein, 5 aa, Plasmodium falciparum
AYGDK

SEQ ID NO: 3398142 - protein, 10 aa, Plasmodium falciparum
CANDGDNKDI

SEQ ID NO: 3398143 - protein, 5 aa, Plasmodium falciparum
CDNEL

SEQ ID NO: 3398144 - protein, 16 aa, Plasmodium falciparum
CDTNNKIRDEAPQAYK

SEQ ID NO: 3398145 - protein, 12 aa, Plasmodium falciparum
CEAPENYSGGCN

SEQ ID NO: 3398146 - protein, 8 aa, Plasmodium falciparum
CEEKTSPG

SEQ ID NO: 3398147 - protein, 4 aa, Plasmodium falciparum
CEES

SEQ ID NO: 3398148 - protein, 11 aa, Plasmodium falciparum
CENDEEKNNIK

SEQ ID NO: 3398149 - protein, 6 aa, Plasmodium falciparum
CENKNI

SEQ ID NO: 3398150 - protein, 28 aa, Plasmodium falciparum
CGLRGSVQSDDSKYEENINPGDVVVAHK

SEQ ID NO: 3398151 - protein, 11 aa, Plasmodium falciparum
CHNDQDQNEYS

SEQ ID NO: 3398152 - protein, 10 aa, Plasmodium falciparum
CHQSNEGYSV

SEQ ID NO: 3398153 - protein, 5 aa, Plasmodium falciparum
CKCPS

SEQ ID NO: 3398154 - protein, 8 aa, Plasmodium falciparum
CKDKPSPG

SEQ ID NO: 3398155 - protein, 9 aa, Plasmodium falciparum
CKGGKHKDK

SEQ ID NO: 3398156 - protein, 6 aa, Plasmodium falciparum
CKKDYS

SEQ ID NO: 3398157 - protein, 8 aa, Plasmodium falciparum
CKKENDNK

SEQ ID NO: 3398158 - protein, 19 aa, Plasmodium falciparum
CKNAGDNKNSEDGYTTSGN

SEQ ID NO: 3398159 - protein, 9 aa, Plasmodium falciparum
CKNKPSPGY

SEQ ID NO: 3398160 - protein, 6 aa, Plasmodium falciparum
CKRKEY

SEQ ID NO: 3398161 - protein, 6 aa, Plasmodium falciparum
CNEEES

SEQ ID NO: 3398162 - protein, 15 aa, Plasmodium falciparum
CNENINESNNATNEL

SEQ ID NO: 3398163 - protein, 9 aa, Plasmodium falciparum
CNKGKKSIY

SEQ ID NO: 3398164 - protein, 14 aa, Plasmodium falciparum
CNNNGKVSSKGKKR

SEQ ID NO: 3398165 - protein, 21 aa, Plasmodium falciparum
CNNTNKGFSDLDGNSLDAARY

SEQ ID NO: 3398166 - protein, 15 aa, Plasmodium falciparum
CNTENVGGPISSSTR

SEQ ID NO: 3398167 - protein, 5 aa, Plasmodium falciparum
CNTES

SEQ ID NO: 3398168 - protein, 10 aa, Plasmodium falciparum
CNTQNYDKEN

SEQ ID NO: 3398169 - protein, 6 aa, Plasmodium falciparum
CNTYKK

SEQ ID NO: 3398170 - protein, 12 aa, Plasmodium falciparum
CPPKNSTGRNGD

SEQ ID NO: 3398171 - protein, 5 aa, Plasmodium falciparum
CQNSL

SEQ ID NO: 3398172 - protein, 6 aa, Plasmodium falciparum
CQPDWT

SEQ ID NO: 3398173 - protein, 4 aa, Plasmodium falciparum
CSED

SEQ ID NO: 3398174 - protein, 8 aa, Plasmodium falciparum
CSNNKEEN

SEQ ID NO: 3398175 - protein, 8 aa, Plasmodium falciparum
CSNNPGLC

SEQ ID NO: 3398176 - protein, 10 aa, Plasmodium falciparum
CSNSSKSQGY

SEQ ID NO: 3398177 - protein, 5 aa, Plasmodium falciparum
CSPEP

SEQ ID NO: 3398178 - protein, 10 aa, Plasmodium falciparum
CSSSSEFSGT

SEQ ID NO: 3398179 - protein, 6 aa, Plasmodium falciparum
CTEQNY

SEQ ID NO: 3398180 - protein, 10 aa, Plasmodium falciparum
DAANSDDARD

SEQ ID NO: 3398181 - protein, 9 aa, Plasmodium falciparum
DADDSLQKE

SEQ ID NO: 3398182 - protein, 9 aa, Plasmodium falciparum
DADSPIKQN

SEQ ID NO: 3398183 - protein, 16 aa, Plasmodium falciparum
DAGPSYMTEGNKNVNK

SEQ ID NO: 3398184 - protein, 5 aa, Plasmodium falciparum
DAHHA

SEQ ID NO: 3398185 - protein, 9 aa, Plasmodium falciparum
DAKRGGPKT

SEQ ID NO: 3398186 - protein, 8 aa, Plasmodium falciparum
DAKYEKSK

SEQ ID NO: 3398187 - protein, 13 aa, Plasmodium falciparum
DALSDAEHYNDGS

SEQ ID NO: 3398188 - protein, 7 aa, Plasmodium falciparum
DANPSDD

SEQ ID NO: 3398189 - protein, 9 aa, Plasmodium falciparum
DAPKGKYDK

SEQ ID NO: 3398190 - protein, 4 aa, Plasmodium falciparum
DASH

SEQ ID NO: 3398191 - protein, 8 aa, Plasmodium falciparum
DASKNKEK

SEQ ID NO: 3398192 - protein, 18 aa, Plasmodium falciparum
DAVENEQEDENKEKSESF

SEQ ID NO: 3398193 - protein, 13 aa, Plasmodium falciparum
DCKKEEKKIDSNI

SEQ ID NO: 3398194 - protein, 4 aa, Plasmodium falciparum
DCND

SEQ ID NO: 3398195 - protein, 6 aa, Plasmodium falciparum
DCSKGS

SEQ ID NO: 3398196 - protein, 4 aa, Plasmodium falciparum
DDDD

SEQ ID NO: 3398197 - protein, 11 aa, Plasmodium falciparum
DDDDKEGGNFK

SEQ ID NO: 3398198 - protein, 56 aa, Plasmodium falciparum
DDDNDDDENNEVSSNDENNNDENNSNENNSNENNSNENNSNENNIDDSQQVDEEQH

SEQ ID NO: 3398199 - protein, 9 aa, Plasmodium falciparum
DDDNDSNDK

SEQ ID NO: 3398200 - protein, 9 aa, Plasmodium falciparum
DDDNNNNNY

SEQ ID NO: 3398201 - protein, 4 aa, Plasmodium falciparum
DDEC

SEQ ID NO: 3398202 - protein, 4 aa, Plasmodium falciparum
DDED

SEQ ID NO: 3398203 - protein, 7 aa, Plasmodium falciparum
DDELSEA

SEQ ID NO: 3398204 - protein, 9 aa, Plasmodium falciparum
DDFSNTNDV

SEQ ID NO: 3398205 - protein, 7 aa, Plasmodium falciparum
DDGEDKQ

SEQ ID NO: 3398206 - protein, 4 aa, Plasmodium falciparum
DDHN

SEQ ID NO: 3398207 - protein, 8 aa, Plasmodium falciparum
DDITDEQK

SEQ ID NO: 3398208 - protein, 7 aa, Plasmodium falciparum
DDKEERQ

SEQ ID NO: 3398209 - protein, 4 aa, Plasmodium falciparum
DDKN

SEQ ID NO: 3398210 - protein, 27 aa, Plasmodium falciparum
DDKVNKDDTLNNNNDTLNSNNTLNHDN

SEQ ID NO: 3398211 - protein, 46 aa, Plasmodium falciparum
DDLEKRKSDNTLGKRQKKEDDDDEEETDEDDDEDSDEDDEEQEELN

SEQ ID NO: 3398212 - protein, 11 aa, Plasmodium falciparum
DDLNKSLKNAE

SEQ ID NO: 3398213 - protein, 14 aa, Plasmodium falciparum
DDLSDDKDRSEGWN

SEQ ID NO: 3398214 - protein, 7 aa, Plasmodium falciparum
DDNDPCP

SEQ ID NO: 3398215 - protein, 10 aa, Plasmodium falciparum
DDNDQDIKNS

SEQ ID NO: 3398216 - protein, 28 aa, Plasmodium falciparum
DDNECDDDNECDDDNECDDYKDDEDIAN

SEQ ID NO: 3398217 - protein, 4 aa, Plasmodium falciparum
DDNG

SEQ ID NO: 3398218 - protein, 5 aa, Plasmodium falciparum
DDNTT

SEQ ID NO: 3398219 - protein, 4 aa, Plasmodium falciparum
DDNY

SEQ ID NO: 3398220 - protein, 4 aa, Plasmodium falciparum
DDPF

SEQ ID NO: 3398221 - protein, 6 aa, Plasmodium falciparum
DDPNRI

SEQ ID NO: 3398222 - protein, 26 aa, Plasmodium falciparum
DDQDIYDQGDNTFDNKYDKQKTKNEF

SEQ ID NO: 3398223 - protein, 19 aa, Plasmodium falciparum
DDQTYTDCTRATDPNGITG

SEQ ID NO: 3398224 - protein, 4 aa, Plasmodium falciparum
DDSE

SEQ ID NO: 3398225 - protein, 4 aa, Plasmodium falciparum
DDSK

SEQ ID NO: 3398226 - protein, 7 aa, Plasmodium falciparum
DDSMDGP

SEQ ID NO: 3398227 - protein, 7 aa, Plasmodium falciparum
DDTHKAT

SEQ ID NO: 3398228 - protein, 4 aa, Plasmodium falciparum
DDTM

SEQ ID NO: 3398229 - protein, 8 aa, Plasmodium falciparum
DDTNENGS

SEQ ID NO: 3398230 - protein, 11 aa, Plasmodium falciparum
DDVEDDSKNEI

SEQ ID NO: 3398231 - protein, 7 aa, Plasmodium falciparum
DDYKKSG

SEQ ID NO: 3398232 - protein, 10 aa, Plasmodium falciparum
DEAGDTTDSG

SEQ ID NO: 3398233 - protein, 16 aa, Plasmodium falciparum
DEDNDNIDSKNNELGD

SEQ ID NO: 3398234 - protein, 13 aa, Plasmodium falciparum
DEEAPPAPKNTLT

SEQ ID NO: 3398235 - protein, 27 aa, Plasmodium falciparum
DEEEEEEEEEEEEEEEEEEEEEEEEEY

SEQ ID NO: 3398236 - protein, 13 aa, Plasmodium falciparum
DEEENNTTNEEKV

SEQ ID NO: 3398237 - protein, 9 aa, Plasmodium falciparum
DEEETEDEY

SEQ ID NO: 3398238 - protein, 7 aa, Plasmodium falciparum
DEEGEKK

SEQ ID NO: 3398239 - protein, 4 aa, Plasmodium falciparum
DEEK

SEQ ID NO: 3398240 - protein, 5 aa, Plasmodium falciparum
DEEKK

SEQ ID NO: 3398241 - protein, 6 aa, Plasmodium falciparum
DEEKRK

SEQ ID NO: 3398242 - protein, 6 aa, Plasmodium falciparum
DEEMSK

SEQ ID NO: 3398243 - protein, 9 aa, Plasmodium falciparum
DEENADYEK

SEQ ID NO: 3398244 - protein, 13 aa, Plasmodium falciparum
DEENKDGKENIDE

SEQ ID NO: 3398245 - protein, 11 aa, Plasmodium falciparum
DEENKSNSTMR

SEQ ID NO: 3398246 - protein, 19 aa, Plasmodium falciparum
DEERQKKIKQQQEEEQQEQ

SEQ ID NO: 3398247 - protein, 7 aa, Plasmodium falciparum
DEGIQEQ

SEQ ID NO: 3398248 - protein, 4 aa, Plasmodium falciparum
DEGN

SEQ ID NO: 3398249 - protein, 53 aa, Plasmodium falciparum
DEIDNNMNNTGNTNTSEKNNRDNISNNNNNNNNNKRTKKNSKESAQKYKYSSG

SEQ ID NO: 3398250 - protein, 13 aa, Plasmodium falciparum
DEINENDDNKNPL

SEQ ID NO: 3398251 - protein, 11 aa, Plasmodium falciparum
DEKDNMEEKKT

SEQ ID NO: 3398252 - protein, 16 aa, Plasmodium falciparum
DEKEKNNNNSLDTNVT

SEQ ID NO: 3398253 - protein, 8 aa, Plasmodium falciparum
DEKEKTKK

SEQ ID NO: 3398254 - protein, 11 aa, Plasmodium falciparum
DEKENIKKNAY

SEQ ID NO: 3398255 - protein, 11 aa, Plasmodium falciparum
DEKHKDSTKWD

SEQ ID NO: 3398256 - protein, 36 aa, Plasmodium falciparum
DEKMGNSDVDETKKNEKYDKNIKKENCSNTKEELNK

SEQ ID NO: 3398257 - protein, 9 aa, Plasmodium falciparum
DEKRDRSSK

SEQ ID NO: 3398258 - protein, 33 aa, Plasmodium falciparum
DEKRRSSTKDGKNKEQNNNKMNSDDVHDNNNNM

SEQ ID NO: 3398259 - protein, 9 aa, Plasmodium falciparum
DEKTKKKIA

SEQ ID NO: 3398260 - protein, 12 aa, Plasmodium falciparum
DEKVNDLSSPKF

SEQ ID NO: 3398261 - protein, 5 aa, Plasmodium falciparum
DEKYH

SEQ ID NO: 3398262 - protein, 9 aa, Plasmodium falciparum
DENDAQDDL

SEQ ID NO: 3398263 - protein, 5 aa, Plasmodium falciparum
DENDP

SEQ ID NO: 3398264 - protein, 4 aa, Plasmodium falciparum
DENN

SEQ ID NO: 3398265 - protein, 7 aa, Plasmodium falciparum
DENNEEF

SEQ ID NO: 3398266 - protein, 57 aa, Plasmodium falciparum
DENPENPPNPPNPPNPPNPPNPPNPDIPEQEPNIPEDSEKEVPSDVPKNPEDDREEN

SEQ ID NO: 3398267 - protein, 6 aa, Plasmodium falciparum
DENRKP

SEQ ID NO: 3398268 - protein, 5 aa, Plasmodium falciparum
DENVD

SEQ ID NO: 3398269 - protein, 7 aa, Plasmodium falciparum
DEQKKEL

SEQ ID NO: 3398270 - protein, 11 aa, Plasmodium falciparum
DEQKKKKKKKK

SEQ ID NO: 3398271 - protein, 12 aa, Plasmodium falciparum
DEQKKKKKKNIS

SEQ ID NO: 3398272 - protein, 10 aa, Plasmodium falciparum
DEQKKNPNIY

SEQ ID NO: 3398273 - protein, 4 aa, Plasmodium falciparum
DEQN

SEQ ID NO: 3398274 - protein, 14 aa, Plasmodium falciparum
DEQNEKKSNSTLNN

SEQ ID NO: 3398275 - protein, 6 aa, Plasmodium falciparum
DEQNFT

SEQ ID NO: 3398276 - protein, 11 aa, Plasmodium falciparum
DERDISPHNVN

SEQ ID NO: 3398277 - protein, 6 aa, Plasmodium falciparum
DERPIE

SEQ ID NO: 3398278 - protein, 7 aa, Plasmodium falciparum
DESEKED

SEQ ID NO: 3398279 - protein, 9 aa, Plasmodium falciparum
DESEQENSI

SEQ ID NO: 3398280 - protein, 8 aa, Plasmodium falciparum
DESSQDKN

SEQ ID NO: 3398281 - protein, 137 aa, Plasmodium falciparum
DETKEDGQKGDDKPNGDDKPNGDDKPNGDDKPNGDDKPNGDDKPNGDDKPNGDDKPNGDDKPNGDDKPNGDDKPNSDDKQSSDDKRNSDDKQNSDDKQNSDDKQNSDDKQNSDDKQNSDDKQNSDDNNGGSESSSNI

SEQ ID NO: 3398282 - protein, 4 aa, Plasmodium falciparum
DEVN

SEQ ID NO: 3398283 - protein, 62 aa, Plasmodium falciparum
DEVNKNKEKKEEKKNEKNKNQKNEEQNSKDIHTKNAVQQSKLRPTKENFTEKKEEKEKNTKL

SEQ ID NO: 3398284 - protein, 6 aa, Plasmodium falciparum
DEYEEG

SEQ ID NO: 3398285 - protein, 6 aa, Plasmodium falciparum
DEYESK

SEQ ID NO: 3398286 - protein, 6 aa, Plasmodium falciparum
DEYNKS

SEQ ID NO: 3398287 - protein, 8 aa, Plasmodium falciparum
DEYSDSND

SEQ ID NO: 3398288 - protein, 16 aa, Plasmodium falciparum
DFDTDSVGGPISPTTK

SEQ ID NO: 3398289 - protein, 8 aa, Plasmodium falciparum
DFKGTSKS

SEQ ID NO: 3398290 - protein, 8 aa, Plasmodium falciparum
DFKNDNDI

SEQ ID NO: 3398291 - protein, 12 aa, Plasmodium falciparum
DFSSGTSSKSTK

SEQ ID NO: 3398292 - protein, 37 aa, Plasmodium falciparum
DGDDEKGVTTDSRDNDCQQKGNVDTQERNKTENDTTR

SEQ ID NO: 3398293 - protein, 8 aa, Plasmodium falciparum
DGDVSNSL

SEQ ID NO: 3398294 - protein, 28 aa, Plasmodium falciparum
DGEEVKTEYVSEKNEEVENKSETEIGEE

SEQ ID NO: 3398295 - protein, 5 aa, Plasmodium falciparum
DGEIT

SEQ ID NO: 3398296 - protein, 5 aa, Plasmodium falciparum
DGEKE

SEQ ID NO: 3398297 - protein, 6 aa, Plasmodium falciparum
DGESVG

SEQ ID NO: 3398298 - protein, 107 aa, Plasmodium falciparum
DGGHDEDDYDDDENVGDENDDDEENDDDENDDDEENDDDENDDDEENDDDDDENDDDDENDDDDENDDDDENVGDDDENDDDDENVGDENIDDDDDDDYNNYNNKEL

SEQ ID NO: 3398299 - protein, 8 aa, Plasmodium falciparum
DGHKSGSI

SEQ ID NO: 3398300 - protein, 12 aa, Plasmodium falciparum
DGINTEDPNYDN

SEQ ID NO: 3398301 - protein, 6 aa, Plasmodium falciparum
DGKYKE

SEQ ID NO: 3398302 - protein, 7 aa, Plasmodium falciparum
DGNAYDD

SEQ ID NO: 3398303 - protein, 7 aa, Plasmodium falciparum
DGNEPYE

SEQ ID NO: 3398304 - protein, 7 aa, Plasmodium falciparum
DGNEREP

SEQ ID NO: 3398305 - protein, 11 aa, Plasmodium falciparum
DGNKSLGSTQN

SEQ ID NO: 3398306 - protein, 11 aa, Plasmodium falciparum
DGNNYKKKEAY

SEQ ID NO: 3398307 - protein, 8 aa, Plasmodium falciparum
DGRAKEGI

SEQ ID NO: 3398308 - protein, 8 aa, Plasmodium falciparum
DGSNENKN

SEQ ID NO: 3398309 - protein, 7 aa, Plasmodium falciparum
DGSNKDY

SEQ ID NO: 3398310 - protein, 5 aa, Plasmodium falciparum
DGTPF

SEQ ID NO: 3398311 - protein, 9 aa, Plasmodium falciparum
DGTRKDAPK

SEQ ID NO: 3398312 - protein, 13 aa, Plasmodium falciparum
DGVCSAPKNYNGP

SEQ ID NO: 3398313 - protein, 11 aa, Plasmodium falciparum
DHDIDSKEYTE

SEQ ID NO: 3398314 - protein, 18 aa, Plasmodium falciparum
DHNEHEKNTEENKIEEQY

SEQ ID NO: 3398315 - protein, 26 aa, Plasmodium falciparum
DHTNDHTNDHTNDHTNDHTNDHTNDH

SEQ ID NO: 3398316 - protein, 5 aa, Plasmodium falciparum
DHYSP

SEQ ID NO: 3398317 - protein, 5 aa, Plasmodium falciparum
DIEEE

SEQ ID NO: 3398318 - protein, 7 aa, Plasmodium falciparum
DIEEEEE

SEQ ID NO: 3398319 - protein, 26 aa, Plasmodium falciparum
DIEEKKKKKKTTSKRNNKSSNQINDD

SEQ ID NO: 3398320 - protein, 5 aa, Plasmodium falciparum
DIEKY

SEQ ID NO: 3398321 - protein, 11 aa, Plasmodium falciparum
DIKKDSPTIEN

SEQ ID NO: 3398322 - protein, 11 aa, Plasmodium falciparum
DIKRNTKDSLD

SEQ ID NO: 3398323 - protein, 12 aa, Plasmodium falciparum
DINDKKKEQKRN

SEQ ID NO: 3398324 - protein, 19 aa, Plasmodium falciparum
DINGLKNDKTIDVNGPILL

SEQ ID NO: 3398325 - protein, 9 aa, Plasmodium falciparum
DINKNVSET

SEQ ID NO: 3398326 - protein, 15 aa, Plasmodium falciparum
DIPDDKKKKQEEDDI

SEQ ID NO: 3398327 - protein, 10 aa, Plasmodium falciparum
DIRKSENKDI

SEQ ID NO: 3398328 - protein, 5 aa, Plasmodium falciparum
DISEN

SEQ ID NO: 3398329 - protein, 10 aa, Plasmodium falciparum
DISKKKKKNM

SEQ ID NO: 3398330 - protein, 33 aa, Plasmodium falciparum
DISKNNNNNNNNNNNNNNNNNNNNNNNNNNNKI

SEQ ID NO: 3398331 - protein, 4 aa, Plasmodium falciparum
DISP

SEQ ID NO: 3398332 - protein, 5 aa, Plasmodium falciparum
DISQK

SEQ ID NO: 3398333 - protein, 5 aa, Plasmodium falciparum
DKDEN

SEQ ID NO: 3398334 - protein, 9 aa, Plasmodium falciparum
DKDENVKDV

SEQ ID NO: 3398335 - protein, 8 aa, Plasmodium falciparum
DKDKTGTI

SEQ ID NO: 3398336 - protein, 60 aa, Plasmodium falciparum
DKDNENSVDKKKDKKEKKHKKDKKEKKEKKDKKEKKDKKEKKHKKEKKHKKDKKKEENSE

SEQ ID NO: 3398337 - protein, 5 aa, Plasmodium falciparum
DKDRN

SEQ ID NO: 3398338 - protein, 6 aa, Plasmodium falciparum
DKDSQN

SEQ ID NO: 3398339 - protein, 9 aa, Plasmodium falciparum
DKDTTFAPE

SEQ ID NO: 3398340 - protein, 6 aa, Plasmodium falciparum
DKEENM

SEQ ID NO: 3398341 - protein, 4 aa, Plasmodium falciparum
DKEN

SEQ ID NO: 3398342 - protein, 7 aa, Plasmodium falciparum
DKEPDHA

SEQ ID NO: 3398343 - protein, 7 aa, Plasmodium falciparum
DKEYNAD

SEQ ID NO: 3398344 - protein, 8 aa, Plasmodium falciparum
DKFDNNDY

SEQ ID NO: 3398345 - protein, 6 aa, Plasmodium falciparum
DKFSSE

SEQ ID NO: 3398346 - protein, 7 aa, Plasmodium falciparum
DKGETWG

SEQ ID NO: 3398347 - protein, 8 aa, Plasmodium falciparum
DKGNEYER

SEQ ID NO: 3398348 - protein, 5 aa, Plasmodium falciparum
DKGSL

SEQ ID NO: 3398349 - protein, 7 aa, Plasmodium falciparum
DKGTDED

SEQ ID NO: 3398350 - protein, 5 aa, Plasmodium falciparum
DKHGN

SEQ ID NO: 3398351 - protein, 5 aa, Plasmodium falciparum
DKINP

SEQ ID NO: 3398352 - protein, 7 aa, Plasmodium falciparum
DKKEETS

SEQ ID NO: 3398353 - protein, 95 aa, Plasmodium falciparum
DKKERKQKEKEMKEQEKIEKKKKKQEEKEKKKQEKERKKQEKKERKQKEKEMKKQKKIEKERKKKEEKEKKKKKHDKENEETMQQPDQTSEETNN

SEQ ID NO: 3398354 - protein, 18 aa, Plasmodium falciparum
DKKFTKKLKKSGRYIYEI

SEQ ID NO: 3398355 - protein, 4 aa, Plasmodium falciparum
DKKK

SEQ ID NO: 3398356 - protein, 5 aa, Plasmodium falciparum
DKKKQ

SEQ ID NO: 3398357 - protein, 15 aa, Plasmodium falciparum
DKKLSSSVVNTNDKA

SEQ ID NO: 3398358 - protein, 7 aa, Plasmodium falciparum
DKKPDHA

SEQ ID NO: 3398359 - protein, 4 aa, Plasmodium falciparum
DKKR

SEQ ID NO: 3398360 - protein, 7 aa, Plasmodium falciparum
DKKRNYK

SEQ ID NO: 3398361 - protein, 4 aa, Plasmodium falciparum
DKKY

SEQ ID NO: 3398362 - protein, 16 aa, Plasmodium falciparum
DKMSDTSKKNDRNFRS

SEQ ID NO: 3398363 - protein, 11 aa, Plasmodium falciparum
DKNAEQATTTQ

SEQ ID NO: 3398364 - protein, 16 aa, Plasmodium falciparum
DKNCNDNVRKNQKDLN

SEQ ID NO: 3398365 - protein, 5 aa, Plasmodium falciparum
DKNDE

SEQ ID NO: 3398366 - protein, 10 aa, Plasmodium falciparum
DKNDKITRSS

SEQ ID NO: 3398367 - protein, 8 aa, Plasmodium falciparum
DKNDSTKN

SEQ ID NO: 3398368 - protein, 7 aa, Plasmodium falciparum
DKNESLA

SEQ ID NO: 3398369 - protein, 60 aa, Plasmodium falciparum
DKNGEHDEEEERKCDDDQHSENQEHECDNDQHSENQEHECDNEQNDESKCEESNNTDQAD

SEQ ID NO: 3398370 - protein, 7 aa, Plasmodium falciparum
DKNGNEV

SEQ ID NO: 3398371 - protein, 19 aa, Plasmodium falciparum
DKNGTDEYSPKLNDDETFD

SEQ ID NO: 3398372 - protein, 47 aa, Plasmodium falciparum
DKNIDNNNNNKKDNKKDDINNNDKKNKINDTPAQNITNDKDKNYSNN

SEQ ID NO: 3398373 - protein, 4 aa, Plasmodium falciparum
DKNK

SEQ ID NO: 3398374 - protein, 8 aa, Plasmodium falciparum
DKNKNDFR

SEQ ID NO: 3398375 - protein, 15 aa, Plasmodium falciparum
DKNRKKILDRKAAKE

SEQ ID NO: 3398376 - protein, 5 aa, Plasmodium falciparum
DKNSC

SEQ ID NO: 3398377 - protein, 14 aa, Plasmodium falciparum
DKNSPEDKDNKGKG

SEQ ID NO: 3398378 - protein, 8 aa, Plasmodium falciparum
DKNSTKID

SEQ ID NO: 3398379 - protein, 9 aa, Plasmodium falciparum
DKNYKGPCR

SEQ ID NO: 3398380 - protein, 7 aa, Plasmodium falciparum
DKPCPND

SEQ ID NO: 3398381 - protein, 11 aa, Plasmodium falciparum
DKPESANNENI

SEQ ID NO: 3398382 - protein, 14 aa, Plasmodium falciparum
DKPNHEVTKDEGKN

SEQ ID NO: 3398383 - protein, 5 aa, Plasmodium falciparum
DKSHR

SEQ ID NO: 3398384 - protein, 7 aa, Plasmodium falciparum
DKSPDSL

SEQ ID NO: 3398385 - protein, 10 aa, Plasmodium falciparum
DKSVTEPAEH

SEQ ID NO: 3398386 - protein, 8 aa, Plasmodium falciparum
DKTDGISG

SEQ ID NO: 3398387 - protein, 6 aa, Plasmodium falciparum
DKTMNK

SEQ ID NO: 3398388 - protein, 6 aa, Plasmodium falciparum
DKTSSD

SEQ ID NO: 3398389 - protein, 14 aa, Plasmodium falciparum
DKVVTDENKNKYNE

SEQ ID NO: 3398390 - protein, 4 aa, Plasmodium falciparum
DKYG

SEQ ID NO: 3398391 - protein, 20 aa, Plasmodium falciparum
DKYGDINNDKYGDNHNNEDM

SEQ ID NO: 3398392 - protein, 12 aa, Plasmodium falciparum
DKYNTDEESINK

SEQ ID NO: 3398393 - protein, 7 aa, Plasmodium falciparum
DLEDDLT

SEQ ID NO: 3398394 - protein, 29 aa, Plasmodium falciparum
DLEGNSIDDTKGLSVTNSGFDDGSAFGGG

SEQ ID NO: 3398395 - protein, 10 aa, Plasmodium falciparum
DLKRNKNNNI

SEQ ID NO: 3398396 - protein, 17 aa, Plasmodium falciparum
DLNPENEDTKERFEEKE

SEQ ID NO: 3398397 - protein, 7 aa, Plasmodium falciparum
DLNSETI

SEQ ID NO: 3398398 - protein, 17 aa, Plasmodium falciparum
DLPNTDNVTKDKNVVET

SEQ ID NO: 3398399 - protein, 6 aa, Plasmodium falciparum
DLQNPD

SEQ ID NO: 3398400 - protein, 9 aa, Plasmodium falciparum
DLRSGDTCK

SEQ ID NO: 3398401 - protein, 4 aa, Plasmodium falciparum
DLSK

SEQ ID NO: 3398402 - protein, 7 aa, Plasmodium falciparum
DLSKNNN

SEQ ID NO: 3398403 - protein, 15 aa, Plasmodium falciparum
DMDDDERKRRGSENK

SEQ ID NO: 3398404 - protein, 5 aa, Plasmodium falciparum
DMEEE

SEQ ID NO: 3398405 - protein, 9 aa, Plasmodium falciparum
DMNEKEKIE

SEQ ID NO: 3398406 - protein, 4 aa, Plasmodium falciparum
DMNT

SEQ ID NO: 3398407 - protein, 10 aa, Plasmodium falciparum
DMSDDGGNND

SEQ ID NO: 3398408 - protein, 8 aa, Plasmodium falciparum
DNAGVNGD

SEQ ID NO: 3398409 - protein, 5 aa, Plasmodium falciparum
DNAQN

SEQ ID NO: 3398410 - protein, 7 aa, Plasmodium falciparum
DNATNKI

SEQ ID NO: 3398411 - protein, 26 aa, Plasmodium falciparum
DNDDDNDADEDEDEDDDDDDDLDEDE

SEQ ID NO: 3398412 - protein, 22 aa, Plasmodium falciparum
DNDNDTDISTDKRNNPLNRNNK

SEQ ID NO: 3398413 - protein, 8 aa, Plasmodium falciparum
DNDNTSNL

SEQ ID NO: 3398414 - protein, 4 aa, Plasmodium falciparum
DNDP

SEQ ID NO: 3398415 - protein, 4 aa, Plasmodium falciparum
DNDT

SEQ ID NO: 3398416 - protein, 5 aa, Plasmodium falciparum
DNEEE

SEQ ID NO: 3398417 - protein, 10 aa, Plasmodium falciparum
DNEENYMNSG

SEQ ID NO: 3398418 - protein, 5 aa, Plasmodium falciparum
DNENL

SEQ ID NO: 3398419 - protein, 72 aa, Plasmodium falciparum
DNERKQSDPQSQDNNGNRHVPNSEDRETRPHGRNNENRSYNRKHNNTPKHPEREEHEKPDNNKKKAGSDNKY

SEQ ID NO: 3398420 - protein, 5 aa, Plasmodium falciparum
DNGDE

SEQ ID NO: 3398421 - protein, 8 aa, Plasmodium falciparum
DNGEPNNY

SEQ ID NO: 3398422 - protein, 10 aa, Plasmodium falciparum
DNGGCSRNSE

SEQ ID NO: 3398423 - protein, 5 aa, Plasmodium falciparum
DNHHD

SEQ ID NO: 3398424 - protein, 6 aa, Plasmodium falciparum
DNHPEN

SEQ ID NO: 3398425 - protein, 12 aa, Plasmodium falciparum
DNIESEKLTQGD

SEQ ID NO: 3398426 - protein, 14 aa, Plasmodium falciparum
DNIKSSLKGHIFCY

SEQ ID NO: 3398427 - protein, 5 aa, Plasmodium falciparum
DNIND

SEQ ID NO: 3398428 - protein, 40 aa, Plasmodium falciparum
DNKDSEINNITKEKDDNNNNNGTKQIEEKNKINKSDLHRQ

SEQ ID NO: 3398429 - protein, 10 aa, Plasmodium falciparum
DNKDYNNSEE

SEQ ID NO: 3398430 - protein, 9 aa, Plasmodium falciparum
DNKENKTID

SEQ ID NO: 3398431 - protein, 8 aa, Plasmodium falciparum
DNKNLKNN

SEQ ID NO: 3398432 - protein, 12 aa, Plasmodium falciparum
DNKNMKNGGKLS

SEQ ID NO: 3398433 - protein, 11 aa, Plasmodium falciparum
DNKSEYYGTPD

SEQ ID NO: 3398434 - protein, 4 aa, Plasmodium falciparum
DNLS

SEQ ID NO: 3398435 - protein, 7 aa, Plasmodium falciparum
DNNEERS

SEQ ID NO: 3398436 - protein, 8 aa, Plasmodium falciparum
DNNENEKM

SEQ ID NO: 3398437 - protein, 10 aa, Plasmodium falciparum
DNNKNYIESN

SEQ ID NO: 3398438 - protein, 5 aa, Plasmodium falciparum
DNNNM

SEQ ID NO: 3398439 - protein, 20 aa, Plasmodium falciparum
DNNNNKNNIIENNNDDMSEK

SEQ ID NO: 3398440 - protein, 17 aa, Plasmodium falciparum
DNNNNNNNMNVSGNNSI

SEQ ID NO: 3398441 - protein, 9 aa, Plasmodium falciparum
DNNPNNQIN

SEQ ID NO: 3398442 - protein, 17 aa, Plasmodium falciparum
DNNTKNMSRNNNDDNNH

SEQ ID NO: 3398443 - protein, 5 aa, Plasmodium falciparum
DNNYK

SEQ ID NO: 3398444 - protein, 5 aa, Plasmodium falciparum
DNQLT

SEQ ID NO: 3398445 - protein, 6 aa, Plasmodium falciparum
DNRNSY

SEQ ID NO: 3398446 - protein, 6 aa, Plasmodium falciparum
DNSCKA

SEQ ID NO: 3398447 - protein, 6 aa, Plasmodium falciparum
DNSGGK

SEQ ID NO: 3398448 - protein, 8 aa, Plasmodium falciparum
DNSGTPEY

SEQ ID NO: 3398449 - protein, 7 aa, Plasmodium falciparum
DNSNIKQ

SEQ ID NO: 3398450 - protein, 10 aa, Plasmodium falciparum
DNSNLSAPEK

SEQ ID NO: 3398451 - protein, 16 aa, Plasmodium falciparum
DNSPEQYRQKEKQQQV

SEQ ID NO: 3398452 - protein, 69 aa, Plasmodium falciparum
DNTDDDDDDDGDDDDDNNDDDDDEKEKEKEKENEKGKGKGKGKKKENKETSDDNNKNAGTSTLRGKKKK

SEQ ID NO: 3398453 - protein, 6 aa, Plasmodium falciparum
DNTNPK

SEQ ID NO: 3398454 - protein, 18 aa, Plasmodium falciparum
DNTSEQDDINEKNNDNGD

SEQ ID NO: 3398455 - protein, 5 aa, Plasmodium falciparum
DNVTD

SEQ ID NO: 3398456 - protein, 5 aa, Plasmodium falciparum
DNYKT

SEQ ID NO: 3398457 - protein, 9 aa, Plasmodium falciparum
DPDGNQDQT

SEQ ID NO: 3398458 - protein, 5 aa, Plasmodium falciparum
DPEKY

SEQ ID NO: 3398459 - protein, 8 aa, Plasmodium falciparum
DPENDENI

SEQ ID NO: 3398460 - protein, 11 aa, Plasmodium falciparum
DPESEQSKEER

SEQ ID NO: 3398461 - protein, 8 aa, Plasmodium falciparum
DPGQDLSN

SEQ ID NO: 3398462 - protein, 7 aa, Plasmodium falciparum
DPKIQEK

SEQ ID NO: 3398463 - protein, 9 aa, Plasmodium falciparum
DPKTSSSYK

SEQ ID NO: 3398464 - protein, 5 aa, Plasmodium falciparum
DPLNT

SEQ ID NO: 3398465 - protein, 12 aa, Plasmodium falciparum
DPNAAKANEKDE

SEQ ID NO: 3398466 - protein, 6 aa, Plasmodium falciparum
DPNKLT

SEQ ID NO: 3398467 - protein, 4 aa, Plasmodium falciparum
DPNN

SEQ ID NO: 3398468 - protein, 13 aa, Plasmodium falciparum
DPNNKNQNEDNVD

SEQ ID NO: 3398469 - protein, 8 aa, Plasmodium falciparum
DPNNLPPT

SEQ ID NO: 3398470 - protein, 11 aa, Plasmodium falciparum
DPRGATLKRGT

SEQ ID NO: 3398471 - protein, 10 aa, Plasmodium falciparum
DPSKENAPKE

SEQ ID NO: 3398472 - protein, 13 aa, Plasmodium falciparum
DPSKRNKNNKVNR

SEQ ID NO: 3398473 - protein, 6 aa, Plasmodium falciparum
DPYKEI

SEQ ID NO: 3398474 - protein, 9 aa, Plasmodium falciparum
DQADNTTKL

SEQ ID NO: 3398475 - protein, 15 aa, Plasmodium falciparum
DQDDRLSRHDDYNKN

SEQ ID NO: 3398476 - protein, 7 aa, Plasmodium falciparum
DQDNPLN

SEQ ID NO: 3398477 - protein, 32 aa, Plasmodium falciparum
DQEGQTHSELNPETSEHSKDLNNNDSKNESSD

SEQ ID NO: 3398478 - protein, 5 aa, Plasmodium falciparum
DQESK

SEQ ID NO: 3398479 - protein, 4 aa, Plasmodium falciparum
DQEV

SEQ ID NO: 3398480 - protein, 15 aa, Plasmodium falciparum
DQFDEKKKKRVHVEV

SEQ ID NO: 3398481 - protein, 8 aa, Plasmodium falciparum
DQHHNNNY

SEQ ID NO: 3398482 - protein, 4 aa, Plasmodium falciparum
DQKD

SEQ ID NO: 3398483 - protein, 10 aa, Plasmodium falciparum
DQKKAKSQLS

SEQ ID NO: 3398484 - protein, 78 aa, Plasmodium falciparum
DQNDDGDDTKDGDDTKDEDDHKNEDDHKNEDDHKNEDDHKNEDDHKNGDDNKNGDDHKNGDDNKNGDDDNGKKSHDIS

SEQ ID NO: 3398485 - protein, 5 aa, Plasmodium falciparum
DQNIN

SEQ ID NO: 3398486 - protein, 19 aa, Plasmodium falciparum
DQPEGEHEDEHMDDPSPTI

SEQ ID NO: 3398487 - protein, 39 aa, Plasmodium falciparum
DQPNISTSTQGSENNTSGVSTNNNLTNPNDPTQLNEQEC

SEQ ID NO: 3398488 - protein, 6 aa, Plasmodium falciparum
DQQGEL

SEQ ID NO: 3398489 - protein, 4 aa, Plasmodium falciparum
DQRK

SEQ ID NO: 3398490 - protein, 10 aa, Plasmodium falciparum
DQSGNNLPKL

SEQ ID NO: 3398491 - protein, 6 aa, Plasmodium falciparum
DQTNRL

SEQ ID NO: 3398492 - protein, 24 aa, Plasmodium falciparum
DQTVQNNDNSNICNNNNEGDGERD

SEQ ID NO: 3398493 - protein, 5 aa, Plasmodium falciparum
DRDIN

SEQ ID NO: 3398494 - protein, 10 aa, Plasmodium falciparum
DRLKEGEQER

SEQ ID NO: 3398495 - protein, 8 aa, Plasmodium falciparum
DRPEDKRN

SEQ ID NO: 3398496 - protein, 7 aa, Plasmodium falciparum
DRPPFDK

SEQ ID NO: 3398497 - protein, 4 aa, Plasmodium falciparum
DRSA

SEQ ID NO: 3398498 - protein, 6 aa, Plasmodium falciparum
DRSPCS

SEQ ID NO: 3398499 - protein, 14 aa, Plasmodium falciparum
DSAAGSAKQARNRE

SEQ ID NO: 3398500 - protein, 8 aa, Plasmodium falciparum
DSAAQEND

SEQ ID NO: 3398501 - protein, 172 aa, Plasmodium falciparum
DSEEENKEGTYEDSDEDSEEENKEGTYEDSDEESDEESDEESDEESDEESDEESDEESDEESDEESDEESDEESDDEIDEESDEESDEECDEESDDEIDEESDEESDEESDEESDEESDEEFDEENDYDNDDDNDDDSDEEFDEEDDYDNDEENDYYNDEDDEESDEELDEE

SEQ ID NO: 3398502 - protein, 15 aa, Plasmodium falciparum
DSEHAGKSKACEGCP

SEQ ID NO: 3398503 - protein, 5 aa, Plasmodium falciparum
DSFDT

SEQ ID NO: 3398504 - protein, 7 aa, Plasmodium falciparum
DSGETHI

SEQ ID NO: 3398505 - protein, 7 aa, Plasmodium falciparum
DSGQLTE

SEQ ID NO: 3398506 - protein, 5 aa, Plasmodium falciparum
DSIEV

SEQ ID NO: 3398507 - protein, 7 aa, Plasmodium falciparum
DSIKNND

SEQ ID NO: 3398508 - protein, 8 aa, Plasmodium falciparum
DSKEEPKV

SEQ ID NO: 3398509 - protein, 4 aa, Plasmodium falciparum
DSKL

SEQ ID NO: 3398510 - protein, 17 aa, Plasmodium falciparum
DSKSIRKRKKKLNKRYS

SEQ ID NO: 3398511 - protein, 8 aa, Plasmodium falciparum
DSKSSTNN

SEQ ID NO: 3398512 - protein, 5 aa, Plasmodium falciparum
DSMDG

SEQ ID NO: 3398513 - protein, 8 aa, Plasmodium falciparum
DSMDGDSI

SEQ ID NO: 3398514 - protein, 4 aa, Plasmodium falciparum
DSMP

SEQ ID NO: 3398515 - protein, 5 aa, Plasmodium falciparum
DSMTR

SEQ ID NO: 3398516 - protein, 5 aa, Plasmodium falciparum
DSNNI

SEQ ID NO: 3398517 - protein, 5 aa, Plasmodium falciparum
DSNYD

SEQ ID NO: 3398518 - protein, 7 aa, Plasmodium falciparum
DSPDGLA

SEQ ID NO: 3398519 - protein, 5 aa, Plasmodium falciparum
DSPLA

SEQ ID NO: 3398520 - protein, 15 aa, Plasmodium falciparum
DSQKGKADQAENKKS

SEQ ID NO: 3398521 - protein, 54 aa, Plasmodium falciparum
DSSETDSTKDDGKPDDDDDDDDNFDDDDNFDDDTVEEEDASGDLFKNEKKDENK

SEQ ID NO: 3398522 - protein, 8 aa, Plasmodium falciparum
DSSFQSQN

SEQ ID NO: 3398523 - protein, 4 aa, Plasmodium falciparum
DSSI

SEQ ID NO: 3398524 - protein, 7 aa, Plasmodium falciparum
DSSTADA

SEQ ID NO: 3398525 - protein, 19 aa, Plasmodium falciparum
DSTDINENPRNLENKNAPL

SEQ ID NO: 3398526 - protein, 5 aa, Plasmodium falciparum
DSTEK

SEQ ID NO: 3398527 - protein, 5 aa, Plasmodium falciparum
DSTNK

SEQ ID NO: 3398528 - protein, 11 aa, Plasmodium falciparum
DSTQDDKAQKL

SEQ ID NO: 3398529 - protein, 4 aa, Plasmodium falciparum
DSVE

SEQ ID NO: 3398530 - protein, 6 aa, Plasmodium falciparum
DSYNHN

SEQ ID NO: 3398531 - protein, 26 aa, Plasmodium falciparum
DTAGSGQSGKESNTALESAGTSNEVS

SEQ ID NO: 3398532 - protein, 6 aa, Plasmodium falciparum
DTAPDS

SEQ ID NO: 3398533 - protein, 5 aa, Plasmodium falciparum
DTDSN

SEQ ID NO: 3398534 - protein, 6 aa, Plasmodium falciparum
DTEERR

SEQ ID NO: 3398535 - protein, 6 aa, Plasmodium falciparum
DTEGGI

SEQ ID NO: 3398536 - protein, 17 aa, Plasmodium falciparum
DTINENKNDDNDDNNIH

SEQ ID NO: 3398537 - protein, 8 aa, Plasmodium falciparum
DTKEEEDI

SEQ ID NO: 3398538 - protein, 17 aa, Plasmodium falciparum
DTKNQEDGNQKSTTEYV

SEQ ID NO: 3398539 - protein, 7 aa, Plasmodium falciparum
DTLDREG

SEQ ID NO: 3398540 - protein, 6 aa, Plasmodium falciparum
DTNGYG

SEQ ID NO: 3398541 - protein, 5 aa, Plasmodium falciparum
DTPYY

SEQ ID NO: 3398542 - protein, 4 aa, Plasmodium falciparum
DTRN

SEQ ID NO: 3398543 - protein, 8 aa, Plasmodium falciparum
DTSYSSYN

SEQ ID NO: 3398544 - protein, 7 aa, Plasmodium falciparum
DTTGTLD

SEQ ID NO: 3398545 - protein, 8 aa, Plasmodium falciparum
DTTNEETH

SEQ ID NO: 3398546 - protein, 67 aa, Plasmodium falciparum
DTTNQKDQEGISKNNNKLKVDEKDKNKLRINDNNNNNNNNNNNNNNNNKHGVDNNDTMHNNQNNNMP

SEQ ID NO: 3398547 - protein, 8 aa, Plasmodium falciparum
DTTSGVDK

SEQ ID NO: 3398548 - protein, 4 aa, Plasmodium falciparum
DTVE

SEQ ID NO: 3398549 - protein, 12 aa, Plasmodium falciparum
DTVTKNSAPPIN

SEQ ID NO: 3398550 - protein, 20 aa, Plasmodium falciparum
DTYGGKGIEARKYDEDKNNG

SEQ ID NO: 3398551 - protein, 7 aa, Plasmodium falciparum
DVAGEGE

SEQ ID NO: 3398552 - protein, 8 aa, Plasmodium falciparum
DVDETNKN

SEQ ID NO: 3398553 - protein, 12 aa, Plasmodium falciparum
DVKDNRKDIQDH

SEQ ID NO: 3398554 - protein, 7 aa, Plasmodium falciparum
DVKDNTE

SEQ ID NO: 3398555 - protein, 5 aa, Plasmodium falciparum
DVNKK

SEQ ID NO: 3398556 - protein, 9 aa, Plasmodium falciparum
DVNKKKAKK

SEQ ID NO: 3398557 - protein, 5 aa, Plasmodium falciparum
DVNKN

SEQ ID NO: 3398558 - protein, 8 aa, Plasmodium falciparum
DVPDSLKG

SEQ ID NO: 3398559 - protein, 8 aa, Plasmodium falciparum
DVQPEKEE

SEQ ID NO: 3398560 - protein, 80 aa, Plasmodium falciparum
DVREEIEEQQEDIEEDEEELENEGEETKEEDDEEKNETNDTEDTDDTEDTEDIEEENKEKELSNQQQSEKKSISKVDEDS

SEQ ID NO: 3398561 - protein, 22 aa, Plasmodium falciparum
DVSKKEKNIKELEKKKKEKPPI

SEQ ID NO: 3398562 - protein, 5 aa, Plasmodium falciparum
DVSPS

SEQ ID NO: 3398563 - protein, 15 aa, Plasmodium falciparum
DVSYNDSNNGNSTLS

SEQ ID NO: 3398564 - protein, 15 aa, Plasmodium falciparum
DYDNNDYNNEENYND

SEQ ID NO: 3398565 - protein, 6 aa, Plasmodium falciparum
DYEDSE

SEQ ID NO: 3398566 - protein, 10 aa, Plasmodium falciparum
DYEENKENVE

SEQ ID NO: 3398567 - protein, 34 aa, Plasmodium falciparum
DYKNDEDKTNNNNNNNNNNNNNNNNNNYHNNNNY

SEQ ID NO: 3398568 - protein, 14 aa, Plasmodium falciparum
DYKSQIKEYKNSTN

SEQ ID NO: 3398569 - protein, 6 aa, Plasmodium falciparum
DYNKSD

SEQ ID NO: 3398570 - protein, 4 aa, Plasmodium falciparum
DYNN

SEQ ID NO: 3398571 - protein, 13 aa, Plasmodium falciparum
DYSNKKKNLTSPQ

SEQ ID NO: 3398572 - protein, 23 aa, Plasmodium falciparum
DYVQEGSSCVKKEKDKIYIRYAK

SEQ ID NO: 3398573 - protein, 6 aa, Plasmodium falciparum
DYVSST

SEQ ID NO: 3398574 - protein, 7 aa, Plasmodium falciparum
EAAKKTS

SEQ ID NO: 3398575 - protein, 9 aa, Plasmodium falciparum
EADAKMDKN

SEQ ID NO: 3398576 - protein, 4 aa, Plasmodium falciparum
EAEL

SEQ ID NO: 3398577 - protein, 26 aa, Plasmodium falciparum
EALNENKKKNPTSTPSDDEEKKENKK

SEQ ID NO: 3398578 - protein, 7 aa, Plasmodium falciparum
EAPYNSK

SEQ ID NO: 3398579 - protein, 4 aa, Plasmodium falciparum
EASI

SEQ ID NO: 3398580 - protein, 7 aa, Plasmodium falciparum
EASKKNN

SEQ ID NO: 3398581 - protein, 4 aa, Plasmodium falciparum
EASY

SEQ ID NO: 3398582 - protein, 4 aa, Plasmodium falciparum
EAVS

SEQ ID NO: 3398583 - protein, 6 aa, Plasmodium falciparum
EAYEGK

SEQ ID NO: 3398584 - protein, 11 aa, Plasmodium falciparum
EAYSRTESSIK

SEQ ID NO: 3398585 - protein, 10 aa, Plasmodium falciparum
ECDKTKNAYK

SEQ ID NO: 3398586 - protein, 6 aa, Plasmodium falciparum
ECNNDV

SEQ ID NO: 3398587 - protein, 15 aa, Plasmodium falciparum
EDDDEGDDERDEENY

SEQ ID NO: 3398588 - protein, 6 aa, Plasmodium falciparum
EDDSKE

SEQ ID NO: 3398589 - protein, 19 aa, Plasmodium falciparum
EDEDEDEEDITDDEENSKL

SEQ ID NO: 3398590 - protein, 8 aa, Plasmodium falciparum
EDEDKDGV

SEQ ID NO: 3398591 - protein, 7 aa, Plasmodium falciparum
EDEDPTF

SEQ ID NO: 3398592 - protein, 20 aa, Plasmodium falciparum
EDEEEEKYGNQIEEDEHNEK

SEQ ID NO: 3398593 - protein, 6 aa, Plasmodium falciparum
EDEEPY

SEQ ID NO: 3398594 - protein, 54 aa, Plasmodium falciparum
EDEHNIDGDNSNDIDNNDDDEHNLDTNNNNDRGDHVNNDNDDDNENSINRNNNG

SEQ ID NO: 3398595 - protein, 6 aa, Plasmodium falciparum
EDEKTV

SEQ ID NO: 3398596 - protein, 14 aa, Plasmodium falciparum
EDELSDAEHYNDGG

SEQ ID NO: 3398597 - protein, 13 aa, Plasmodium falciparum
EDESKTTENADIK

SEQ ID NO: 3398598 - protein, 7 aa, Plasmodium falciparum
EDGDGKS

SEQ ID NO: 3398599 - protein, 12 aa, Plasmodium falciparum
EDGNVKKKKKPV

SEQ ID NO: 3398600 - protein, 15 aa, Plasmodium falciparum
EDGTQEGNVVEGENN

SEQ ID NO: 3398601 - protein, 7 aa, Plasmodium falciparum
EDIKSNA

SEQ ID NO: 3398602 - protein, 5 aa, Plasmodium falciparum
EDIQT

SEQ ID NO: 3398603 - protein, 13 aa, Plasmodium falciparum
EDKGTGKSRGITI

SEQ ID NO: 3398604 - protein, 7 aa, Plasmodium falciparum
EDKHYED

SEQ ID NO: 3398605 - protein, 4 aa, Plasmodium falciparum
EDKL

SEQ ID NO: 3398606 - protein, 17 aa, Plasmodium falciparum
EDKNNNNDNINDYNNNV

SEQ ID NO: 3398607 - protein, 4 aa, Plasmodium falciparum
EDKS

SEQ ID NO: 3398608 - protein, 9 aa, Plasmodium falciparum
EDKSYNDRD

SEQ ID NO: 3398609 - protein, 9 aa, Plasmodium falciparum
EDLTATKEN

SEQ ID NO: 3398610 - protein, 6 aa, Plasmodium falciparum
EDMEGN

SEQ ID NO: 3398611 - protein, 8 aa, Plasmodium falciparum
EDNDKADD

SEQ ID NO: 3398612 - protein, 9 aa, Plasmodium falciparum
EDNENTDMD

SEQ ID NO: 3398613 - protein, 28 aa, Plasmodium falciparum
EDNHDDNDDENDKKKKKDNKLSKDSNRI

SEQ ID NO: 3398614 - protein, 11 aa, Plasmodium falciparum
EDNINNKSSYY

SEQ ID NO: 3398615 - protein, 9 aa, Plasmodium falciparum
EDNKKEKNV

SEQ ID NO: 3398616 - protein, 14 aa, Plasmodium falciparum
EDNKSENKEKKYTQ

SEQ ID NO: 3398617 - protein, 13 aa, Plasmodium falciparum
EDNKSKNGKTDIV

SEQ ID NO: 3398618 - protein, 21 aa, Plasmodium falciparum
EDNPNSTYENMNKSNTYINET

SEQ ID NO: 3398619 - protein, 6 aa, Plasmodium falciparum
EDPKEI

SEQ ID NO: 3398620 - protein, 7 aa, Plasmodium falciparum
EDQGNCD

SEQ ID NO: 3398621 - protein, 4 aa, Plasmodium falciparum
EDRH

SEQ ID NO: 3398622 - protein, 8 aa, Plasmodium falciparum
EDRKRADQ

SEQ ID NO: 3398623 - protein, 8 aa, Plasmodium falciparum
EDSESSKS

SEQ ID NO: 3398624 - protein, 6 aa, Plasmodium falciparum
EDTEIE

SEQ ID NO: 3398625 - protein, 6 aa, Plasmodium falciparum
EDTEKD

SEQ ID NO: 3398626 - protein, 10 aa, Plasmodium falciparum
EDTLNSPKRE

SEQ ID NO: 3398627 - protein, 5 aa, Plasmodium falciparum
EDTPK

SEQ ID NO: 3398628 - protein, 7 aa, Plasmodium falciparum
EDTTDDE

SEQ ID NO: 3398629 - protein, 127 aa, Plasmodium falciparum
EDVDEEEEEEEEKEEEKESRKSKKSKKKETETDEKKKDEKEKDEKEKDVNEKDEKEKDEKEKDVNEKDEKEKDEKEKDEKEKDEKEKDEKEKDEKEKDEKEKDEKKKDEKEKDEKEKDEKEKKVSNI

SEQ ID NO: 3398630 - protein, 11 aa, Plasmodium falciparum
EDVPSKTITAD

SEQ ID NO: 3398631 - protein, 7 aa, Plasmodium falciparum
EDVYDPK

SEQ ID NO: 3398632 - protein, 5 aa, Plasmodium falciparum
EEAAE

SEQ ID NO: 3398633 - protein, 4 aa, Plasmodium falciparum
EEAI

SEQ ID NO: 3398634 - protein, 6 aa, Plasmodium falciparum
EEAQKS

SEQ ID NO: 3398635 - protein, 6 aa, Plasmodium falciparum
EEASNK

SEQ ID NO: 3398636 - protein, 98 aa, Plasmodium falciparum
EEDDQDEEEAEDNDEYDDDDMDNDVDSDVDNDVDNDVDNDVDNDVDNDIDSDIDSDIDSDMDSDMDSDMDSDMDSDMDNDMDNDIDSYDNDYNDYSSG

SEQ ID NO: 3398637 - protein, 10 aa, Plasmodium falciparum
EEDDSKDDME

SEQ ID NO: 3398638 - protein, 6 aa, Plasmodium falciparum
EEEDYQ

SEQ ID NO: 3398639 - protein, 7 aa, Plasmodium falciparum
EEEEEKI

SEQ ID NO: 3398640 - protein, 9 aa, Plasmodium falciparum
EEEEERNKT

SEQ ID NO: 3398641 - protein, 8 aa, Plasmodium falciparum
EEEEKNNV

SEQ ID NO: 3398642 - protein, 10 aa, Plasmodium falciparum
EEEKEKRAKI

SEQ ID NO: 3398643 - protein, 6 aa, Plasmodium falciparum
EEEKFS

SEQ ID NO: 3398644 - protein, 10 aa, Plasmodium falciparum
EEEKKKEQQM

SEQ ID NO: 3398645 - protein, 4 aa, Plasmodium falciparum
EEEL

SEQ ID NO: 3398646 - protein, 19 aa, Plasmodium falciparum
EEENEKNNCNNSRNNNNKE

SEQ ID NO: 3398647 - protein, 24 aa, Plasmodium falciparum
EEENTEVESAENNHTNSLNPNESC

SEQ ID NO: 3398648 - protein, 5 aa, Plasmodium falciparum
EEENY

SEQ ID NO: 3398649 - protein, 9 aa, Plasmodium falciparum
EEERKRKKL

SEQ ID NO: 3398650 - protein, 5 aa, Plasmodium falciparum
EEESC

SEQ ID NO: 3398651 - protein, 11 aa, Plasmodium falciparum
EEEYNKQYGNI

SEQ ID NO: 3398652 - protein, 10 aa, Plasmodium falciparum
EEGEKVPEEV

SEQ ID NO: 3398653 - protein, 18 aa, Plasmodium falciparum
EEGKEKGLQKKKKGINKR

SEQ ID NO: 3398654 - protein, 18 aa, Plasmodium falciparum
EEGNSSKKEYKNLKDEEK

SEQ ID NO: 3398655 - protein, 8 aa, Plasmodium falciparum
EEGSTDSF

SEQ ID NO: 3398656 - protein, 14 aa, Plasmodium falciparum
EEHENKSYQNKDNN

SEQ ID NO: 3398657 - protein, 7 aa, Plasmodium falciparum
EEIDKRP

SEQ ID NO: 3398658 - protein, 4 aa, Plasmodium falciparum
EEIK

SEQ ID NO: 3398659 - protein, 4 aa, Plasmodium falciparum
EEIN

SEQ ID NO: 3398660 - protein, 16 aa, Plasmodium falciparum
EEINNGTYKSPYNEEQ

SEQ ID NO: 3398661 - protein, 4 aa, Plasmodium falciparum
EEIV

SEQ ID NO: 3398662 - protein, 12 aa, Plasmodium falciparum
EEKEGTNNIREE

SEQ ID NO: 3398663 - protein, 6 aa, Plasmodium falciparum
EEKEKR

SEQ ID NO: 3398664 - protein, 16 aa, Plasmodium falciparum
EEKENSNNDGSRRKNK

SEQ ID NO: 3398665 - protein, 10 aa, Plasmodium falciparum
EEKERMRQRS

SEQ ID NO: 3398666 - protein, 7 aa, Plasmodium falciparum
EEKKEQL

SEQ ID NO: 3398667 - protein, 11 aa, Plasmodium falciparum
EEKKKISKRNN

SEQ ID NO: 3398668 - protein, 15 aa, Plasmodium falciparum
EEKKKTEKKNDTQDI

SEQ ID NO: 3398669 - protein, 20 aa, Plasmodium falciparum
EEKNNSDKLQDDIDEDEEKY

SEQ ID NO: 3398670 - protein, 13 aa, Plasmodium falciparum
EEKPDTTTRIAPG

SEQ ID NO: 3398671 - protein, 11 aa, Plasmodium falciparum
EEKQNSQESVE

SEQ ID NO: 3398672 - protein, 10 aa, Plasmodium falciparum
EEKSEEPSSK

SEQ ID NO: 3398673 - protein, 9 aa, Plasmodium falciparum
EEKSVTGRK

SEQ ID NO: 3398674 - protein, 9 aa, Plasmodium falciparum
EEKTQVTEA

SEQ ID NO: 3398675 - protein, 8 aa, Plasmodium falciparum
EEKTSWKK

SEQ ID NO: 3398676 - protein, 8 aa, Plasmodium falciparum
EEKYSQTD

SEQ ID NO: 3398677 - protein, 70 aa, Plasmodium falciparum
EELHDETEELYDETEELHDKTDVSHDKTDVSHDKTDVSHDKTDVSHDKTDVSHDKTDVSHDKTDVSHDKT

SEQ ID NO: 3398678 - protein, 4 aa, Plasmodium falciparum
EELK

SEQ ID NO: 3398679 - protein, 11 aa, Plasmodium falciparum
EENADNKEKNK

SEQ ID NO: 3398680 - protein, 5 aa, Plasmodium falciparum
EENES

SEQ ID NO: 3398681 - protein, 8 aa, Plasmodium falciparum
EENKEEEE

SEQ ID NO: 3398682 - protein, 7 aa, Plasmodium falciparum
EENKNTE

SEQ ID NO: 3398683 - protein, 10 aa, Plasmodium falciparum
EENKTKSNCE

SEQ ID NO: 3398684 - protein, 10 aa, Plasmodium falciparum
EENLDNGKNV

SEQ ID NO: 3398685 - protein, 5 aa, Plasmodium falciparum
EENND

SEQ ID NO: 3398686 - protein, 5 aa, Plasmodium falciparum
EENNN

SEQ ID NO: 3398687 - protein, 11 aa, Plasmodium falciparum
EENNQTKENNL

SEQ ID NO: 3398688 - protein, 16 aa, Plasmodium falciparum
EENNVEYENNEEINNE

SEQ ID NO: 3398689 - protein, 9 aa, Plasmodium falciparum
EENSSVSSF

SEQ ID NO: 3398690 - protein, 4 aa, Plasmodium falciparum
EEQG

SEQ ID NO: 3398691 - protein, 8 aa, Plasmodium falciparum
EEQKKQEA

SEQ ID NO: 3398692 - protein, 18 aa, Plasmodium falciparum
EERDKDDNYEDTYDNNNY

SEQ ID NO: 3398693 - protein, 19 aa, Plasmodium falciparum
EERESESYNNNSNLKYNDS

SEQ ID NO: 3398694 - protein, 5 aa, Plasmodium falciparum
EERKL

SEQ ID NO: 3398695 - protein, 5 aa, Plasmodium falciparum
EERNL

SEQ ID NO: 3398696 - protein, 5 aa, Plasmodium falciparum
EESEY

SEQ ID NO: 3398697 - protein, 41 aa, Plasmodium falciparum
EESGDETEEQLQEEHQEEVGAESSEESFNDEDEDSVEARDG

SEQ ID NO: 3398698 - protein, 6 aa, Plasmodium falciparum
EESIGK

SEQ ID NO: 3398699 - protein, 4 aa, Plasmodium falciparum
EESK

SEQ ID NO: 3398700 - protein, 7 aa, Plasmodium falciparum
EESKMKR

SEQ ID NO: 3398701 - protein, 6 aa, Plasmodium falciparum
EETKLK

SEQ ID NO: 3398702 - protein, 10 aa, Plasmodium falciparum
EETKNNLNQN

SEQ ID NO: 3398703 - protein, 5 aa, Plasmodium falciparum
EETNK

SEQ ID NO: 3398704 - protein, 29 aa, Plasmodium falciparum
EETVSQESNPEKADNDGNVSQNSNNELNE

SEQ ID NO: 3398705 - protein, 36 aa, Plasmodium falciparum
EEYENREKKKKEKQQKKKDKLQKKIKKEQDKIKKER

SEQ ID NO: 3398706 - protein, 6 aa, Plasmodium falciparum
EFGTPQ

SEQ ID NO: 3398707 - protein, 7 aa, Plasmodium falciparum
EFSNRKK

SEQ ID NO: 3398708 - protein, 54 aa, Plasmodium falciparum
EGDDHNEEANDEVEEKSKEDNNENNNDNKNNNDNENNNDNKNNNDNKNNNYNNY

SEQ ID NO: 3398709 - protein, 14 aa, Plasmodium falciparum
EGDFPNSKKCKKGH

SEQ ID NO: 3398710 - protein, 8 aa, Plasmodium falciparum
EGDINSRY

SEQ ID NO: 3398711 - protein, 11 aa, Plasmodium falciparum
EGEENHDNREL

SEQ ID NO: 3398712 - protein, 13 aa, Plasmodium falciparum
EGEQAGTAHKEDV

SEQ ID NO: 3398713 - protein, 5 aa, Plasmodium falciparum
EGEQY

SEQ ID NO: 3398714 - protein, 4 aa, Plasmodium falciparum
EGFK

SEQ ID NO: 3398715 - protein, 9 aa, Plasmodium falciparum
EGGELTESV

SEQ ID NO: 3398716 - protein, 14 aa, Plasmodium falciparum
EGGNNQDDNKYNSN

SEQ ID NO: 3398717 - protein, 5 aa, Plasmodium falciparum
EGIAN

SEQ ID NO: 3398718 - protein, 9 aa, Plasmodium falciparum
EGIATSSDT

SEQ ID NO: 3398719 - protein, 20 aa, Plasmodium falciparum
EGKENDNGNSDRNTPNNNNR

SEQ ID NO: 3398720 - protein, 7 aa, Plasmodium falciparum
EGKKKKM

SEQ ID NO: 3398721 - protein, 4 aa, Plasmodium falciparum
EGKN

SEQ ID NO: 3398722 - protein, 9 aa, Plasmodium falciparum
EGNDEIDSN

SEQ ID NO: 3398723 - protein, 10 aa, Plasmodium falciparum
EGNKKDKKKV

SEQ ID NO: 3398724 - protein, 17 aa, Plasmodium falciparum
EGPDKVGEYGPYKQSEK

SEQ ID NO: 3398725 - protein, 6 aa, Plasmodium falciparum
EGPPSV

SEQ ID NO: 3398726 - protein, 15 aa, Plasmodium falciparum
EGQGIQGKSYKEHQN

SEQ ID NO: 3398727 - protein, 6 aa, Plasmodium falciparum
EGSEYE

SEQ ID NO: 3398728 - protein, 12 aa, Plasmodium falciparum
EGTGVNEKNYSE

SEQ ID NO: 3398729 - protein, 11 aa, Plasmodium falciparum
EGVKNRKYNNR

SEQ ID NO: 3398730 - protein, 13 aa, Plasmodium falciparum
EHAHGQGNNDTTY

SEQ ID NO: 3398731 - protein, 7 aa, Plasmodium falciparum
EHETKKK

SEQ ID NO: 3398732 - protein, 19 aa, Plasmodium falciparum
EHGKKKYTRGPVDSETGLI

SEQ ID NO: 3398733 - protein, 8 aa, Plasmodium falciparum
EHKEENDN

SEQ ID NO: 3398734 - protein, 23 aa, Plasmodium falciparum
EHNENNEHNENNENNKNNEYNYD

SEQ ID NO: 3398735 - protein, 7 aa, Plasmodium falciparum
EHNGTNL

SEQ ID NO: 3398736 - protein, 5 aa, Plasmodium falciparum
EHNKI

SEQ ID NO: 3398737 - protein, 5 aa, Plasmodium falciparum
EHNSE

SEQ ID NO: 3398738 - protein, 6 aa, Plasmodium falciparum
EHTSKT

SEQ ID NO: 3398739 - protein, 19 aa, Plasmodium falciparum
EHVEQQEQHSGDNTQEDKD

SEQ ID NO: 3398740 - protein, 7 aa, Plasmodium falciparum
EHYNDGD

SEQ ID NO: 3398741 - protein, 38 aa, Plasmodium falciparum
EIDDKSEETDDETEEVEDSIQDTDSNHTPSNKKKNDLM

SEQ ID NO: 3398742 - protein, 5 aa, Plasmodium falciparum
EIDEN

SEQ ID NO: 3398743 - protein, 8 aa, Plasmodium falciparum
EIDKSTSE

SEQ ID NO: 3398744 - protein, 5 aa, Plasmodium falciparum
EIDSQ

SEQ ID NO: 3398745 - protein, 5 aa, Plasmodium falciparum
EIKTI

SEQ ID NO: 3398746 - protein, 10 aa, Plasmodium falciparum
EINEDDKSAH

SEQ ID NO: 3398747 - protein, 10 aa, Plasmodium falciparum
EINRKGETNM

SEQ ID NO: 3398748 - protein, 10 aa, Plasmodium falciparum
EIPSESLEKS

SEQ ID NO: 3398749 - protein, 19 aa, Plasmodium falciparum
EIQKKDNNVDNESNDKSDE

SEQ ID NO: 3398750 - protein, 14 aa, Plasmodium falciparum
EISPHENKSTSSSI

SEQ ID NO: 3398751 - protein, 4 aa, Plasmodium falciparum
EITE

SEQ ID NO: 3398752 - protein, 7 aa, Plasmodium falciparum
EKAGDLT

SEQ ID NO: 3398753 - protein, 12 aa, Plasmodium falciparum
EKARKDKEKNGY

SEQ ID NO: 3398754 - protein, 4 aa, Plasmodium falciparum
EKCD

SEQ ID NO: 3398755 - protein, 5 aa, Plasmodium falciparum
EKCKE

SEQ ID NO: 3398756 - protein, 6 aa, Plasmodium falciparum
EKDEFR

SEQ ID NO: 3398757 - protein, 11 aa, Plasmodium falciparum
EKDEKEEYEKY

SEQ ID NO: 3398758 - protein, 9 aa, Plasmodium falciparum
EKDKEKHKF

SEQ ID NO: 3398759 - protein, 4 aa, Plasmodium falciparum
EKDL

SEQ ID NO: 3398760 - protein, 9 aa, Plasmodium falciparum
EKDYSSQCP

SEQ ID NO: 3398761 - protein, 13 aa, Plasmodium falciparum
EKEEENNTETQNV

SEQ ID NO: 3398762 - protein, 7 aa, Plasmodium falciparum
EKEENSL

SEQ ID NO: 3398763 - protein, 5 aa, Plasmodium falciparum
EKEER

SEQ ID NO: 3398764 - protein, 4 aa, Plasmodium falciparum
EKEK

SEQ ID NO: 3398765 - protein, 9 aa, Plasmodium falciparum
EKEKEDNTL

SEQ ID NO: 3398766 - protein, 8 aa, Plasmodium falciparum
EKEKNESI

SEQ ID NO: 3398767 - protein, 12 aa, Plasmodium falciparum
EKENKENEEKTN

SEQ ID NO: 3398768 - protein, 9 aa, Plasmodium falciparum
EKENKRNYT

SEQ ID NO: 3398769 - protein, 7 aa, Plasmodium falciparum
EKENNPY

SEQ ID NO: 3398770 - protein, 9 aa, Plasmodium falciparum
EKENRNTKD

SEQ ID NO: 3398771 - protein, 8 aa, Plasmodium falciparum
EKERLDNS

SEQ ID NO: 3398772 - protein, 6 aa, Plasmodium falciparum
EKERTC

SEQ ID NO: 3398773 - protein, 20 aa, Plasmodium falciparum
EKETIKSSDNNTSTNDNKVN

SEQ ID NO: 3398774 - protein, 4 aa, Plasmodium falciparum
EKGG

SEQ ID NO: 3398775 - protein, 19 aa, Plasmodium falciparum
EKGKKNEHIKNDQEENQKI

SEQ ID NO: 3398776 - protein, 5 aa, Plasmodium falciparum
EKGTD

SEQ ID NO: 3398777 - protein, 12 aa, Plasmodium falciparum
EKHTSNDSGSYE

SEQ ID NO: 3398778 - protein, 5 aa, Plasmodium falciparum
EKIAE

SEQ ID NO: 3398779 - protein, 6 aa, Plasmodium falciparum
EKIENE

SEQ ID NO: 3398780 - protein, 20 aa, Plasmodium falciparum
EKIKEDNTRQDNINKKENEI

SEQ ID NO: 3398781 - protein, 16 aa, Plasmodium falciparum
EKKDTVSLPKESTVDK

SEQ ID NO: 3398782 - protein, 7 aa, Plasmodium falciparum
EKKEENI

SEQ ID NO: 3398783 - protein, 20 aa, Plasmodium falciparum
EKKKEDDDNEINTEKRVERD

SEQ ID NO: 3398784 - protein, 6 aa, Plasmodium falciparum
EKKKEK

SEQ ID NO: 3398785 - protein, 6 aa, Plasmodium falciparum
EKKKLD

SEQ ID NO: 3398786 - protein, 21 aa, Plasmodium falciparum
EKKKREMEKEEKKQKEKQNID

SEQ ID NO: 3398787 - protein, 8 aa, Plasmodium falciparum
EKKKSKRM

SEQ ID NO: 3398788 - protein, 9 aa, Plasmodium falciparum
EKKNKKKNE

SEQ ID NO: 3398789 - protein, 5 aa, Plasmodium falciparum
EKKNN

SEQ ID NO: 3398790 - protein, 5 aa, Plasmodium falciparum
EKKNQ

SEQ ID NO: 3398791 - protein, 6 aa, Plasmodium falciparum
EKKNTL

SEQ ID NO: 3398792 - protein, 7 aa, Plasmodium falciparum
EKKPRNK

SEQ ID NO: 3398793 - protein, 5 aa, Plasmodium falciparum
EKKSE

SEQ ID NO: 3398794 - protein, 10 aa, Plasmodium falciparum
EKKSKKSSPL

SEQ ID NO: 3398795 - protein, 7 aa, Plasmodium falciparum
EKKSMEK

SEQ ID NO: 3398796 - protein, 5 aa, Plasmodium falciparum
EKKTC

SEQ ID NO: 3398797 - protein, 7 aa, Plasmodium falciparum
EKKTIGK

SEQ ID NO: 3398798 - protein, 6 aa, Plasmodium falciparum
EKKYDP

SEQ ID NO: 3398799 - protein, 7 aa, Plasmodium falciparum
EKLTDEQ

SEQ ID NO: 3398800 - protein, 20 aa, Plasmodium falciparum
EKNEENDDNEENNDDDNTYE

SEQ ID NO: 3398801 - protein, 6 aa, Plasmodium falciparum
EKNERA

SEQ ID NO: 3398802 - protein, 39 aa, Plasmodium falciparum
EKNGKGQKYEDLEEEKEGENDDEEDSNSEESNNDEENEL

SEQ ID NO: 3398803 - protein, 10 aa, Plasmodium falciparum
EKNGPYNGSA

SEQ ID NO: 3398804 - protein, 17 aa, Plasmodium falciparum
EKNKKNDLDPVAAQEKS

SEQ ID NO: 3398805 - protein, 4 aa, Plasmodium falciparum
EKNL

SEQ ID NO: 3398806 - protein, 4 aa, Plasmodium falciparum
EKNN

SEQ ID NO: 3398807 - protein, 5 aa, Plasmodium falciparum
EKNNN

SEQ ID NO: 3398808 - protein, 12 aa, Plasmodium falciparum
EKNNTYGKTSKG

SEQ ID NO: 3398809 - protein, 8 aa, Plasmodium falciparum
EKNNYTNE

SEQ ID NO: 3398810 - protein, 4 aa, Plasmodium falciparum
EKNP

SEQ ID NO: 3398811 - protein, 9 aa, Plasmodium falciparum
EKNQNHRNT

SEQ ID NO: 3398812 - protein, 9 aa, Plasmodium falciparum
EKNYDGNNI

SEQ ID NO: 3398813 - protein, 4 aa, Plasmodium falciparum
EKPK

SEQ ID NO: 3398814 - protein, 5 aa, Plasmodium falciparum
EKPNE

SEQ ID NO: 3398815 - protein, 7 aa, Plasmodium falciparum
EKPNENI

SEQ ID NO: 3398816 - protein, 6 aa, Plasmodium falciparum
EKPSAI

SEQ ID NO: 3398817 - protein, 6 aa, Plasmodium falciparum
EKQDLD

SEQ ID NO: 3398818 - protein, 15 aa, Plasmodium falciparum
EKQKGNGEQDQKEHE

SEQ ID NO: 3398819 - protein, 21 aa, Plasmodium falciparum
EKQKKKKQQDSYVNEKAEEYN

SEQ ID NO: 3398820 - protein, 8 aa, Plasmodium falciparum
EKQNEGKK

SEQ ID NO: 3398821 - protein, 15 aa, Plasmodium falciparum
EKQNVEEKQNSQIPS

SEQ ID NO: 3398822 - protein, 8 aa, Plasmodium falciparum
EKRDNERK

SEQ ID NO: 3398823 - protein, 5 aa, Plasmodium falciparum
EKRKY

SEQ ID NO: 3398824 - protein, 5 aa, Plasmodium falciparum
EKRQQ

SEQ ID NO: 3398825 - protein, 6 aa, Plasmodium falciparum
EKRTIN

SEQ ID NO: 3398826 - protein, 14 aa, Plasmodium falciparum
EKSATPQKSEENTV

SEQ ID NO: 3398827 - protein, 65 aa, Plasmodium falciparum
EKSEQETEPELEPEVEPEVEPEVEPEVEPEVEPEVEPEVEPEVEPEVDPEVDPENDQGTGSQNNI

SEQ ID NO: 3398828 - protein, 8 aa, Plasmodium falciparum
EKSEVDKT

SEQ ID NO: 3398829 - protein, 9 aa, Plasmodium falciparum
EKSIEENKK

SEQ ID NO: 3398830 - protein, 7 aa, Plasmodium falciparum
EKSKTIS

SEQ ID NO: 3398831 - protein, 5 aa, Plasmodium falciparum
EKSNE

SEQ ID NO: 3398832 - protein, 7 aa, Plasmodium falciparum
EKSNNRL

SEQ ID NO: 3398833 - protein, 10 aa, Plasmodium falciparum
EKSTSEPAEH

SEQ ID NO: 3398834 - protein, 10 aa, Plasmodium falciparum
EKTEVSKKTF

SEQ ID NO: 3398835 - protein, 5 aa, Plasmodium falciparum
EKTKK

SEQ ID NO: 3398836 - protein, 13 aa, Plasmodium falciparum
EKTKKDKDGKTGT

SEQ ID NO: 3398837 - protein, 8 aa, Plasmodium falciparum
EKTKKSAL

SEQ ID NO: 3398838 - protein, 5 aa, Plasmodium falciparum
EKTKT

SEQ ID NO: 3398839 - protein, 11 aa, Plasmodium falciparum
EKVDEKVPEEV

SEQ ID NO: 3398840 - protein, 7 aa, Plasmodium falciparum
EKVRNGK

SEQ ID NO: 3398841 - protein, 10 aa, Plasmodium falciparum
EKYGNTTAGC

SEQ ID NO: 3398842 - protein, 4 aa, Plasmodium falciparum
EKYP

SEQ ID NO: 3398843 - protein, 4 aa, Plasmodium falciparum
ELAQ

SEQ ID NO: 3398844 - protein, 17 aa, Plasmodium falciparum
ELEKQEKMKYEKQEQEK

SEQ ID NO: 3398845 - protein, 11 aa, Plasmodium falciparum
ELKKAKENFED

SEQ ID NO: 3398846 - protein, 11 aa, Plasmodium falciparum
ELKNNPTYKNH

SEQ ID NO: 3398847 - protein, 7 aa, Plasmodium falciparum
ELNDEKA

SEQ ID NO: 3398848 - protein, 5 aa, Plasmodium falciparum
ELNGG

SEQ ID NO: 3398849 - protein, 26 aa, Plasmodium falciparum
ELNNNQKKYSSLTEQEKLEKENEYEN

SEQ ID NO: 3398850 - protein, 9 aa, Plasmodium falciparum
ELPEQTESF

SEQ ID NO: 3398851 - protein, 4 aa, Plasmodium falciparum
ELPF

SEQ ID NO: 3398852 - protein, 20 aa, Plasmodium falciparum
ELPPSGLTKDEEEDVKEDSA

SEQ ID NO: 3398853 - protein, 9 aa, Plasmodium falciparum
ELQNSKEKN

SEQ ID NO: 3398854 - protein, 47 aa, Plasmodium falciparum
ELTTHGDNKENIKDMNSKEDKTSSSNNNNNNNNNKNDYDEDPEGSSV

SEQ ID NO: 3398855 - protein, 6 aa, Plasmodium falciparum
ELTTNT

SEQ ID NO: 3398856 - protein, 7 aa, Plasmodium falciparum
ELTTNTN

SEQ ID NO: 3398857 - protein, 10 aa, Plasmodium falciparum
ELYPKDSKKF

SEQ ID NO: 3398858 - protein, 5 aa, Plasmodium falciparum
EMEKK

SEQ ID NO: 3398859 - protein, 20 aa, Plasmodium falciparum
EMGKAEQRENVNKSSQTQSS

SEQ ID NO: 3398860 - protein, 5 aa, Plasmodium falciparum
ENDDS

SEQ ID NO: 3398861 - protein, 6 aa, Plasmodium falciparum
ENDDSL

SEQ ID NO: 3398862 - protein, 5 aa, Plasmodium falciparum
ENDEG

SEQ ID NO: 3398863 - protein, 7 aa, Plasmodium falciparum
ENDIYDE

SEQ ID NO: 3398864 - protein, 6 aa, Plasmodium falciparum
ENDKKA

SEQ ID NO: 3398865 - protein, 20 aa, Plasmodium falciparum
ENEDKNDSANSLRKEKKNGT

SEQ ID NO: 3398866 - protein, 10 aa, Plasmodium falciparum
ENEDNDEKNI

SEQ ID NO: 3398867 - protein, 16 aa, Plasmodium falciparum
ENEDYETCDKNDKKCK

SEQ ID NO: 3398868 - protein, 78 aa, Plasmodium falciparum
ENEEAEELNNNTTTASSKGDANNSVNTQEGEGEEESFSANEENINNNNNHNNKNYNNYNTSQQEEDDNSFNENDEPLI

SEQ ID NO: 3398869 - protein, 45 aa, Plasmodium falciparum
ENEEENKENKENNQNVNKDNNDNNNNEKKNEEQNHNNEKKQEEVI

SEQ ID NO: 3398870 - protein, 5 aa, Plasmodium falciparum
ENEEP

SEQ ID NO: 3398871 - protein, 12 aa, Plasmodium falciparum
ENEKKKKKRKNI

SEQ ID NO: 3398872 - protein, 18 aa, Plasmodium falciparum
ENENVTPKPSEGESTKPD

SEQ ID NO: 3398873 - protein, 4 aa, Plasmodium falciparum
ENES

SEQ ID NO: 3398874 - protein, 14 aa, Plasmodium falciparum
ENFEENVDDQKDCG

SEQ ID NO: 3398875 - protein, 11 aa, Plasmodium falciparum
ENFNSKNTNNL

SEQ ID NO: 3398876 - protein, 13 aa, Plasmodium falciparum
ENGFEENVSDLTQ

SEQ ID NO: 3398877 - protein, 9 aa, Plasmodium falciparum
ENGKVEPPN

SEQ ID NO: 3398878 - protein, 12 aa, Plasmodium falciparum
ENGSANGNQGSL

SEQ ID NO: 3398879 - protein, 4 aa, Plasmodium falciparum
ENHK

SEQ ID NO: 3398880 - protein, 158 aa, Plasmodium falciparum
ENIEDEENNYKGDNKNVQEKEETEDKVDKKGNGDDKIKDMKETEGGKDEVKDGDKSDETVEGQTEDKIDLKDEDKIDLKDEDKNDLKDEDKSDLKDEDKNDVKGEDKSDLKDEDQNDVKDEDQNDVKDEDKNDVKVEDQNDLKDEDKNEDPNKASVEE

SEQ ID NO: 3398881 - protein, 30 aa, Plasmodium falciparum
ENIGGSAGDIISSSSRAPSSKGSDNVPPNV

SEQ ID NO: 3398882 - protein, 9 aa, Plasmodium falciparum
ENINDKNKN

SEQ ID NO: 3398883 - protein, 76 aa, Plasmodium falciparum
ENINTKTNNVEENIKTNEENINTKTNNVEENIKTNEENINTKTNNVEDNIKTNEENINTKTNNVEENIKTNKENIN

SEQ ID NO: 3398884 - protein, 12 aa, Plasmodium falciparum
ENIPTHEENIPT

SEQ ID NO: 3398885 - protein, 7 aa, Plasmodium falciparum
ENIQASD

SEQ ID NO: 3398886 - protein, 11 aa, Plasmodium falciparum
ENIRSDDKNNN

SEQ ID NO: 3398887 - protein, 9 aa, Plasmodium falciparum
ENKEESLET

SEQ ID NO: 3398888 - protein, 9 aa, Plasmodium falciparum
ENKEKLNEE

SEQ ID NO: 3398889 - protein, 12 aa, Plasmodium falciparum
ENKENTNKIGSY

SEQ ID NO: 3398890 - protein, 9 aa, Plasmodium falciparum
ENKKKKLKK

SEQ ID NO: 3398891 - protein, 10 aa, Plasmodium falciparum
ENKKRNEKKY

SEQ ID NO: 3398892 - protein, 9 aa, Plasmodium falciparum
ENKLNKRAD

SEQ ID NO: 3398893 - protein, 5 aa, Plasmodium falciparum
ENKNF

SEQ ID NO: 3398894 - protein, 16 aa, Plasmodium falciparum
ENKNYRGKELKEEKHK

SEQ ID NO: 3398895 - protein, 18 aa, Plasmodium falciparum
ENKPNKKETPVVDGPKHV

SEQ ID NO: 3398896 - protein, 10 aa, Plasmodium falciparum
ENKSYSYESR

SEQ ID NO: 3398897 - protein, 6 aa, Plasmodium falciparum
ENKVKG

SEQ ID NO: 3398898 - protein, 4 aa, Plasmodium falciparum
ENLK

SEQ ID NO: 3398899 - protein, 9 aa, Plasmodium falciparum
ENLKNIENN

SEQ ID NO: 3398900 - protein, 4 aa, Plasmodium falciparum
ENLS

SEQ ID NO: 3398901 - protein, 12 aa, Plasmodium falciparum
ENLSTCPADHET

SEQ ID NO: 3398902 - protein, 4 aa, Plasmodium falciparum
ENND

SEQ ID NO: 3398903 - protein, 7 aa, Plasmodium falciparum
ENNDKNQ

SEQ ID NO: 3398904 - protein, 5 aa, Plasmodium falciparum
ENNEI

SEQ ID NO: 3398905 - protein, 7 aa, Plasmodium falciparum
ENNEKNL

SEQ ID NO: 3398906 - protein, 36 aa, Plasmodium falciparum
ENNHQNKDNTRNSDNQKLTYQEEAYENNVNKNYDTL

SEQ ID NO: 3398907 - protein, 4 aa, Plasmodium falciparum
ENNI

SEQ ID NO: 3398908 - protein, 72 aa, Plasmodium falciparum
ENNKDNGDSNNNGDSNNNGDSNNNGDSNNNGDSNNNGDSNNNGDNKDNGDSNDNGDNNNDNGDNNDNGDNNI

SEQ ID NO: 3398909 - protein, 33 aa, Plasmodium falciparum
ENNKIEGKDGKKGSEASEKETKEKNSSNYHESS

SEQ ID NO: 3398910 - protein, 7 aa, Plasmodium falciparum
ENNKISN

SEQ ID NO: 3398911 - protein, 7 aa, Plasmodium falciparum
ENNNTFT

SEQ ID NO: 3398912 - protein, 26 aa, Plasmodium falciparum
ENNNTPNVVPPTQSKKKNKNETVSGM

SEQ ID NO: 3398913 - protein, 8 aa, Plasmodium falciparum
ENNSSMNN

SEQ ID NO: 3398914 - protein, 18 aa, Plasmodium falciparum
ENNSYTQSSSDTTNNKNN

SEQ ID NO: 3398915 - protein, 7 aa, Plasmodium falciparum
ENNTYNN

SEQ ID NO: 3398916 - protein, 8 aa, Plasmodium falciparum
ENPDKQRK

SEQ ID NO: 3398917 - protein, 7 aa, Plasmodium falciparum
ENPPHLK

SEQ ID NO: 3398918 - protein, 19 aa, Plasmodium falciparum
ENQATNNNINNQDNSNDVL

SEQ ID NO: 3398919 - protein, 14 aa, Plasmodium falciparum
ENQKEENENENPYN

SEQ ID NO: 3398920 - protein, 8 aa, Plasmodium falciparum
ENQNANVE

SEQ ID NO: 3398921 - protein, 6 aa, Plasmodium falciparum
ENRPDY

SEQ ID NO: 3398922 - protein, 5 aa, Plasmodium falciparum
ENRSE

SEQ ID NO: 3398923 - protein, 9 aa, Plasmodium falciparum
ENSDDVSPS

SEQ ID NO: 3398924 - protein, 19 aa, Plasmodium falciparum
ENSDQHNNGNIKKKKNETI

SEQ ID NO: 3398925 - protein, 11 aa, Plasmodium falciparum
ENSNESVNSNN

SEQ ID NO: 3398926 - protein, 19 aa, Plasmodium falciparum
ENSTCEQIGNGKKAECKCE

SEQ ID NO: 3398927 - protein, 10 aa, Plasmodium falciparum
ENTGKNSNIN

SEQ ID NO: 3398928 - protein, 9 aa, Plasmodium falciparum
ENTPHKEKH

SEQ ID NO: 3398929 - protein, 6 aa, Plasmodium falciparum
ENTSDS

SEQ ID NO: 3398930 - protein, 8 aa, Plasmodium falciparum
ENTSDSNL

SEQ ID NO: 3398931 - protein, 19 aa, Plasmodium falciparum
ENYKNKDDSCVPNTNEYDE

SEQ ID NO: 3398932 - protein, 5 aa, Plasmodium falciparum
ENYYG

SEQ ID NO: 3398933 - protein, 5 aa, Plasmodium falciparum
ENYYN

SEQ ID NO: 3398934 - protein, 7 aa, Plasmodium falciparum
EPERNKK

SEQ ID NO: 3398935 - protein, 37 aa, Plasmodium falciparum
EPLEKSPEDENKEIPTLDSPQNGNPTSYTSNLSTPPL

SEQ ID NO: 3398936 - protein, 4 aa, Plasmodium falciparum
EPND

SEQ ID NO: 3398937 - protein, 10 aa, Plasmodium falciparum
EPNKNNTYHD

SEQ ID NO: 3398938 - protein, 13 aa, Plasmodium falciparum
EPNNDNNNNNNNN

SEQ ID NO: 3398939 - protein, 11 aa, Plasmodium falciparum
EPNSIGSKGYS

SEQ ID NO: 3398940 - protein, 4 aa, Plasmodium falciparum
EPQS

SEQ ID NO: 3398941 - protein, 5 aa, Plasmodium falciparum
EPVNY

SEQ ID NO: 3398942 - protein, 4 aa, Plasmodium falciparum
EQCP

SEQ ID NO: 3398943 - protein, 54 aa, Plasmodium falciparum
EQDAQKGNKNFTNNENNSDNENNSDNENNSDNENNLDNENNLDNENNSDNSSIE

SEQ ID NO: 3398944 - protein, 13 aa, Plasmodium falciparum
EQEEEEEEKKKNK

SEQ ID NO: 3398945 - protein, 10 aa, Plasmodium falciparum
EQEIKESLNS

SEQ ID NO: 3398946 - protein, 8 aa, Plasmodium falciparum
EQGENVTH

SEQ ID NO: 3398947 - protein, 8 aa, Plasmodium falciparum
EQGGGMPY

SEQ ID NO: 3398948 - protein, 8 aa, Plasmodium falciparum
EQHDENDW

SEQ ID NO: 3398949 - protein, 7 aa, Plasmodium falciparum
EQIRGKE

SEQ ID NO: 3398950 - protein, 7 aa, Plasmodium falciparum
EQLEEED

SEQ ID NO: 3398951 - protein, 4 aa, Plasmodium falciparum
EQLQ

SEQ ID NO: 3398952 - protein, 5 aa, Plasmodium falciparum
EQNEF

SEQ ID NO: 3398953 - protein, 10 aa, Plasmodium falciparum
EQNEQNVENV

SEQ ID NO: 3398954 - protein, 7 aa, Plasmodium falciparum
EQNKEEL

SEQ ID NO: 3398955 - protein, 7 aa, Plasmodium falciparum
EQNKTNN

SEQ ID NO: 3398956 - protein, 22 aa, Plasmodium falciparum
EQNNDEHNSLSTKGYTAYESEA

SEQ ID NO: 3398957 - protein, 21 aa, Plasmodium falciparum
EQNNEESGESKLVDNDEGGFE

SEQ ID NO: 3398958 - protein, 6 aa, Plasmodium falciparum
EQNPPV

SEQ ID NO: 3398959 - protein, 7 aa, Plasmodium falciparum
EQNQEPN

SEQ ID NO: 3398960 - protein, 11 aa, Plasmodium falciparum
EQNYEQTKNCR

SEQ ID NO: 3398961 - protein, 6 aa, Plasmodium falciparum
EQPHQS

SEQ ID NO: 3398962 - protein, 6 aa, Plasmodium falciparum
EQRDDN

SEQ ID NO: 3398963 - protein, 14 aa, Plasmodium falciparum
EQRTEFLNKINSYE

SEQ ID NO: 3398964 - protein, 14 aa, Plasmodium falciparum
EQSETTNKPDDNVN

SEQ ID NO: 3398965 - protein, 6 aa, Plasmodium falciparum
EQSPDN

SEQ ID NO: 3398966 - protein, 16 aa, Plasmodium falciparum
EQSTLPKHSNKSVRKK

SEQ ID NO: 3398967 - protein, 10 aa, Plasmodium falciparum
EQTENAPNIT

SEQ ID NO: 3398968 - protein, 6 aa, Plasmodium falciparum
ERAEEL

SEQ ID NO: 3398969 - protein, 9 aa, Plasmodium falciparum
ERALPDEYN

SEQ ID NO: 3398970 - protein, 8 aa, Plasmodium falciparum
ERDRNYEV

SEQ ID NO: 3398971 - protein, 13 aa, Plasmodium falciparum
ERGLGSGALPGTN

SEQ ID NO: 3398972 - protein, 11 aa, Plasmodium falciparum
ERGLKNEHNNY

SEQ ID NO: 3398973 - protein, 6 aa, Plasmodium falciparum
ERHGGY

SEQ ID NO: 3398974 - protein, 7 aa, Plasmodium falciparum
ERHGKGK

SEQ ID NO: 3398975 - protein, 27 aa, Plasmodium falciparum
ERKKIEEEKKKKKKMERDNQSEHEKNE

SEQ ID NO: 3398976 - protein, 6 aa, Plasmodium falciparum
ERKRSS

SEQ ID NO: 3398977 - protein, 7 aa, Plasmodium falciparum
ERKRSVR

SEQ ID NO: 3398978 - protein, 12 aa, Plasmodium falciparum
ERKSNPKSEDEM

SEQ ID NO: 3398979 - protein, 8 aa, Plasmodium falciparum
ERKVGEAA

SEQ ID NO: 3398980 - protein, 44 aa, Plasmodium falciparum
ERNKKGTGKEKKDDKNHNNKEKATDVKKSSVPTNNIDKNEDTTK

SEQ ID NO: 3398981 - protein, 9 aa, Plasmodium falciparum
ERNNSSDKK

SEQ ID NO: 3398982 - protein, 5 aa, Plasmodium falciparum
ERNVA

SEQ ID NO: 3398983 - protein, 5 aa, Plasmodium falciparum
ERPND

SEQ ID NO: 3398984 - protein, 5 aa, Plasmodium falciparum
ERQEV

SEQ ID NO: 3398985 - protein, 5 aa, Plasmodium falciparum
ERRQG

SEQ ID NO: 3398986 - protein, 7 aa, Plasmodium falciparum
ERTEKNN

SEQ ID NO: 3398987 - protein, 6 aa, Plasmodium falciparum
ERTSKI

SEQ ID NO: 3398988 - protein, 7 aa, Plasmodium falciparum
ERYERNK

SEQ ID NO: 3398989 - protein, 16 aa, Plasmodium falciparum
ESAESENENNEHNNNN

SEQ ID NO: 3398990 - protein, 6 aa, Plasmodium falciparum
ESCERD

SEQ ID NO: 3398991 - protein, 7 aa, Plasmodium falciparum
ESDEFTK

SEQ ID NO: 3398992 - protein, 5 aa, Plasmodium falciparum
ESDKL

SEQ ID NO: 3398993 - protein, 8 aa, Plasmodium falciparum
ESDNRNFD

SEQ ID NO: 3398994 - protein, 7 aa, Plasmodium falciparum
ESDQEGM

SEQ ID NO: 3398995 - protein, 4 aa, Plasmodium falciparum
ESEG

SEQ ID NO: 3398996 - protein, 21 aa, Plasmodium falciparum
ESEKSEHEPAENEESSLEEGH

SEQ ID NO: 3398997 - protein, 11 aa, Plasmodium falciparum
ESIKKNKERKL

SEQ ID NO: 3398998 - protein, 5 aa, Plasmodium falciparum
ESKIN

SEQ ID NO: 3398999 - protein, 9 aa, Plasmodium falciparum
ESKKPGNGD

SEQ ID NO: 3399000 - protein, 4 aa, Plasmodium falciparum
ESNL

SEQ ID NO: 3399001 - protein, 9 aa, Plasmodium falciparum
ESNSGSLEK

SEQ ID NO: 3399002 - protein, 7 aa, Plasmodium falciparum
ESQESQM

SEQ ID NO: 3399003 - protein, 7 aa, Plasmodium falciparum
ESSEEVK

SEQ ID NO: 3399004 - protein, 28 aa, Plasmodium falciparum
ESSEKKNQKKKKKEKKEQDGNTDGDRVD

SEQ ID NO: 3399005 - protein, 7 aa, Plasmodium falciparum
ESSGKFE

SEQ ID NO: 3399006 - protein, 9 aa, Plasmodium falciparum
ESSNVPRNV

SEQ ID NO: 3399007 - protein, 7 aa, Plasmodium falciparum
ESTEHAF

SEQ ID NO: 3399008 - protein, 33 aa, Plasmodium falciparum
ESTLPESTLPESTLAESTLAESTLAESTLAESE

SEQ ID NO: 3399009 - protein, 41 aa, Plasmodium falciparum
ESTNYGSNSSSSMSNNYNSKNKNSKKNNKKKSSQKDYIRTD

SEQ ID NO: 3399010 - protein, 11 aa, Plasmodium falciparum
ESTPYKNNNNL

SEQ ID NO: 3399011 - protein, 8 aa, Plasmodium falciparum
ESVSNGRK

SEQ ID NO: 3399012 - protein, 18 aa, Plasmodium falciparum
ESWTPSEYSTCGNSPDTF

SEQ ID NO: 3399013 - protein, 4 aa, Plasmodium falciparum
ETAT

SEQ ID NO: 3399014 - protein, 7 aa, Plasmodium falciparum
ETATGQY

SEQ ID NO: 3399015 - protein, 5 aa, Plasmodium falciparum
ETDKY

SEQ ID NO: 3399016 - protein, 6 aa, Plasmodium falciparum
ETEQTN

SEQ ID NO: 3399017 - protein, 4 aa, Plasmodium falciparum
ETFK

SEQ ID NO: 3399018 - protein, 7 aa, Plasmodium falciparum
ETGINEK

SEQ ID NO: 3399019 - protein, 7 aa, Plasmodium falciparum
ETKEEKM

SEQ ID NO: 3399020 - protein, 10 aa, Plasmodium falciparum
ETKENKKTVE

SEQ ID NO: 3399021 - protein, 13 aa, Plasmodium falciparum
ETKVNNKEKVDKS

SEQ ID NO: 3399022 - protein, 9 aa, Plasmodium falciparum
ETLPTPRDI

SEQ ID NO: 3399023 - protein, 5 aa, Plasmodium falciparum
ETLRE

SEQ ID NO: 3399024 - protein, 10 aa, Plasmodium falciparum
ETLSEKNDKV

SEQ ID NO: 3399025 - protein, 18 aa, Plasmodium falciparum
ETNIDKDSKKKQKRENGI

SEQ ID NO: 3399026 - protein, 6 aa, Plasmodium falciparum
ETNLDP

SEQ ID NO: 3399027 - protein, 11 aa, Plasmodium falciparum
ETNVSEQNDSL

SEQ ID NO: 3399028 - protein, 4 aa, Plasmodium falciparum
ETPY

SEQ ID NO: 3399029 - protein, 5 aa, Plasmodium falciparum
ETQEY

SEQ ID NO: 3399030 - protein, 25 aa, Plasmodium falciparum
ETSNDTKDNDKENISEDKKEDHQQE

SEQ ID NO: 3399031 - protein, 6 aa, Plasmodium falciparum
ETSPGS

SEQ ID NO: 3399032 - protein, 4 aa, Plasmodium falciparum
ETTK

SEQ ID NO: 3399033 - protein, 15 aa, Plasmodium falciparum
ETTNNFYDNMDILLY

SEQ ID NO: 3399034 - protein, 5 aa, Plasmodium falciparum
ETYDK

SEQ ID NO: 3399035 - protein, 7 aa, Plasmodium falciparum
ETYEERS

SEQ ID NO: 3399036 - protein, 7 aa, Plasmodium falciparum
ETYHPSS

SEQ ID NO: 3399037 - protein, 6 aa, Plasmodium falciparum
ETYPAN

SEQ ID NO: 3399038 - protein, 6 aa, Plasmodium falciparum
EVEEKY

SEQ ID NO: 3399039 - protein, 10 aa, Plasmodium falciparum
EVEKDNNKNS

SEQ ID NO: 3399040 - protein, 12 aa, Plasmodium falciparum
EVEKNRKSYLEN

SEQ ID NO: 3399041 - protein, 8 aa, Plasmodium falciparum
EVGDKNRE

SEQ ID NO: 3399042 - protein, 6 aa, Plasmodium falciparum
EVSENT

SEQ ID NO: 3399043 - protein, 5 aa, Plasmodium falciparum
EVSSD

SEQ ID NO: 3399044 - protein, 5 aa, Plasmodium falciparum
EVTSE

SEQ ID NO: 3399045 - protein, 22 aa, Plasmodium falciparum
EWENETHSGNTHPSDSNKTLNT

SEQ ID NO: 3399046 - protein, 16 aa, Plasmodium falciparum
EYAQGNYNISKNRTRL

SEQ ID NO: 3399047 - protein, 7 aa, Plasmodium falciparum
EYDKNNN

SEQ ID NO: 3399048 - protein, 27 aa, Plasmodium falciparum
EYEDEETDNLDNKISDEIKNKKKENYL

SEQ ID NO: 3399049 - protein, 15 aa, Plasmodium falciparum
EYEETTSKYDKEKLN

SEQ ID NO: 3399050 - protein, 6 aa, Plasmodium falciparum
EYERSY

SEQ ID NO: 3399051 - protein, 6 aa, Plasmodium falciparum
EYETYD

SEQ ID NO: 3399052 - protein, 4 aa, Plasmodium falciparum
EYIE

SEQ ID NO: 3399053 - protein, 6 aa, Plasmodium falciparum
EYKKEI

SEQ ID NO: 3399054 - protein, 13 aa, Plasmodium falciparum
EYKKTEEKKSLED

SEQ ID NO: 3399055 - protein, 6 aa, Plasmodium falciparum
EYKTED

SEQ ID NO: 3399056 - protein, 7 aa, Plasmodium falciparum
EYNQSRN

SEQ ID NO: 3399057 - protein, 5 aa, Plasmodium falciparum
EYNSY

SEQ ID NO: 3399058 - protein, 6 aa, Plasmodium falciparum
EYNTKK

SEQ ID NO: 3399059 - protein, 5 aa, Plasmodium falciparum
EYPKG

SEQ ID NO: 3399060 - protein, 11 aa, Plasmodium falciparum
EYRQQHRKTVD

SEQ ID NO: 3399061 - protein, 5 aa, Plasmodium falciparum
EYSNP

SEQ ID NO: 3399062 - protein, 30 aa, Plasmodium falciparum
EYVTNNEKNEKNEKNHDNDDNVHNNNNYPI

SEQ ID NO: 3399063 - protein, 10 aa, Plasmodium falciparum
FDDNTTNVMN

SEQ ID NO: 3399064 - protein, 8 aa, Plasmodium falciparum
FDEKDDDV

SEQ ID NO: 3399065 - protein, 5 aa, Plasmodium falciparum
FDEQG

SEQ ID NO: 3399066 - protein, 6 aa, Plasmodium falciparum
FDGKEE

SEQ ID NO: 3399067 - protein, 5 aa, Plasmodium falciparum
FDNPT

SEQ ID NO: 3399068 - protein, 16 aa, Plasmodium falciparum
FDPTRDTNTRIVELNV

SEQ ID NO: 3399069 - protein, 13 aa, Plasmodium falciparum
FEASNNYNKQNDE

SEQ ID NO: 3399070 - protein, 12 aa, Plasmodium falciparum
FEDDGEPYDEYD

SEQ ID NO: 3399071 - protein, 9 aa, Plasmodium falciparum
FEDSTRQMK

SEQ ID NO: 3399072 - protein, 4 aa, Plasmodium falciparum
FEEK

SEQ ID NO: 3399073 - protein, 5 aa, Plasmodium falciparum
FEKKG

SEQ ID NO: 3399074 - protein, 7 aa, Plasmodium falciparum
FENGQPT

SEQ ID NO: 3399075 - protein, 10 aa, Plasmodium falciparum
FENKNDGEEK

SEQ ID NO: 3399076 - protein, 8 aa, Plasmodium falciparum
FESNRTKI

SEQ ID NO: 3399077 - protein, 6 aa, Plasmodium falciparum
FESSKG

SEQ ID NO: 3399078 - protein, 15 aa, Plasmodium falciparum
FGKGNDVNKKVKEKK

SEQ ID NO: 3399079 - protein, 8 aa, Plasmodium falciparum
FGNGPRYC

SEQ ID NO: 3399080 - protein, 6 aa, Plasmodium falciparum
FGNNNK

SEQ ID NO: 3399081 - protein, 5 aa, Plasmodium falciparum
FGSDN

SEQ ID NO: 3399082 - protein, 8 aa, Plasmodium falciparum
FKDDNKKD

SEQ ID NO: 3399083 - protein, 7 aa, Plasmodium falciparum
FKEDEAS

SEQ ID NO: 3399084 - protein, 8 aa, Plasmodium falciparum
FKEEKKKK

SEQ ID NO: 3399085 - protein, 24 aa, Plasmodium falciparum
FKENDEGLKNENNINNNEDNQNDN

SEQ ID NO: 3399086 - protein, 5 aa, Plasmodium falciparum
FKKND

SEQ ID NO: 3399087 - protein, 44 aa, Plasmodium falciparum
FKNNDTKNNATLSEDNKNRYNITTNKNNEKKEYNMKKSNENEYA

SEQ ID NO: 3399088 - protein, 12 aa, Plasmodium falciparum
FKNRHKRNKSHE

SEQ ID NO: 3399089 - protein, 6 aa, Plasmodium falciparum
FKPGAS

SEQ ID NO: 3399090 - protein, 12 aa, Plasmodium falciparum
FNEKKTNYEYSS

SEQ ID NO: 3399091 - protein, 21 aa, Plasmodium falciparum
FNEQQEQRERKKKAEEDEMNE

SEQ ID NO: 3399092 - protein, 6 aa, Plasmodium falciparum
FNNSDT

SEQ ID NO: 3399093 - protein, 11 aa, Plasmodium falciparum
FNNYSNSTFND

SEQ ID NO: 3399094 - protein, 5 aa, Plasmodium falciparum
FNSNS

SEQ ID NO: 3399095 - protein, 6 aa, Plasmodium falciparum
FNSPNK

SEQ ID NO: 3399096 - protein, 27 aa, Plasmodium falciparum
FNTKNTKINNNNNNNNISNSNGNKVND

SEQ ID NO: 3399097 - protein, 6 aa, Plasmodium falciparum
FNTNHT

SEQ ID NO: 3399098 - protein, 9 aa, Plasmodium falciparum
FPEGDRGGT

SEQ ID NO: 3399099 - protein, 32 aa, Plasmodium falciparum
FPSDNKGKIIRGSNDKLNKNSEDVLEQSEKSL

SEQ ID NO: 3399100 - protein, 18 aa, Plasmodium falciparum
FQSGNENDYENEYENEFE

SEQ ID NO: 3399101 - protein, 8 aa, Plasmodium falciparum
FRKRDKKP

SEQ ID NO: 3399102 - protein, 4 aa, Plasmodium falciparum
FRNE

SEQ ID NO: 3399103 - protein, 5 aa, Plasmodium falciparum
FRSDE

SEQ ID NO: 3399104 - protein, 100 aa, Plasmodium falciparum
FSDKKKNGKNKDTKKEKSKDTEKEKSKDIEKEKSKDKEKEKSKDKEKEKGKDKEKEKSKDIEKEKEKDKDIEKEKSKDTAKEKEKDKDIEKEKSKDMEKL

SEQ ID NO: 3399105 - protein, 14 aa, Plasmodium falciparum
FSEKEDNENNKKLG

SEQ ID NO: 3399106 - protein, 22 aa, Plasmodium falciparum
FSGNNQEKEYSTWKTAQNKSLG

SEQ ID NO: 3399107 - protein, 25 aa, Plasmodium falciparum
FSRKENPFVPTNTKNNSNDDDDMDN

SEQ ID NO: 3399108 - protein, 6 aa, Plasmodium falciparum
FSSDKQ

SEQ ID NO: 3399109 - protein, 12 aa, Plasmodium falciparum
FSSEVSNSELNE

SEQ ID NO: 3399110 - protein, 12 aa, Plasmodium falciparum
FSSIGENGLPQY

SEQ ID NO: 3399111 - protein, 17 aa, Plasmodium falciparum
FSSNKNKNIDYNDDTES

SEQ ID NO: 3399112 - protein, 4 aa, Plasmodium falciparum
FSTN

SEQ ID NO: 3399113 - protein, 5 aa, Plasmodium falciparum
FSTPQ

SEQ ID NO: 3399114 - protein, 4 aa, Plasmodium falciparum
FSVG

SEQ ID NO: 3399115 - protein, 6 aa, Plasmodium falciparum
FTDEQK

SEQ ID NO: 3399116 - protein, 4 aa, Plasmodium falciparum
FTNP

SEQ ID NO: 3399117 - protein, 4 aa, Plasmodium falciparum
FTPT

SEQ ID NO: 3399118 - protein, 6 aa, Plasmodium falciparum
FTQTNA

SEQ ID NO: 3399119 - protein, 6 aa, Plasmodium falciparum
FTSSGT

SEQ ID NO: 3399120 - protein, 14 aa, Plasmodium falciparum
GAEQGVGSADSNTK

SEQ ID NO: 3399121 - protein, 5 aa, Plasmodium falciparum
GAKER

SEQ ID NO: 3399122 - protein, 8 aa, Plasmodium falciparum
GAPSNNGI

SEQ ID NO: 3399123 - protein, 5 aa, Plasmodium falciparum
GAQVD

SEQ ID NO: 3399124 - protein, 7 aa, Plasmodium falciparum
GATGAGL

SEQ ID NO: 3399125 - protein, 15 aa, Plasmodium falciparum
GCGSSTAGGISRYPE

SEQ ID NO: 3399126 - protein, 6 aa, Plasmodium falciparum
GCNREP

SEQ ID NO: 3399127 - protein, 5 aa, Plasmodium falciparum
GDDDN

SEQ ID NO: 3399128 - protein, 7 aa, Plasmodium falciparum
GDDTADH

SEQ ID NO: 3399129 - protein, 14 aa, Plasmodium falciparum
GDEEEKDEGGESFT

SEQ ID NO: 3399130 - protein, 6 aa, Plasmodium falciparum
GDGAFY

SEQ ID NO: 3399131 - protein, 8 aa, Plasmodium falciparum
GDGEPTDN

SEQ ID NO: 3399132 - protein, 4 aa, Plasmodium falciparum
GDIT

SEQ ID NO: 3399133 - protein, 7 aa, Plasmodium falciparum
GDKCETE

SEQ ID NO: 3399134 - protein, 4 aa, Plasmodium falciparum
GDKI

SEQ ID NO: 3399135 - protein, 5 aa, Plasmodium falciparum
GDKLN

SEQ ID NO: 3399136 - protein, 6 aa, Plasmodium falciparum
GDKNNL

SEQ ID NO: 3399137 - protein, 9 aa, Plasmodium falciparum
GDKTKAENV

SEQ ID NO: 3399138 - protein, 8 aa, Plasmodium falciparum
GDLAATSA

SEQ ID NO: 3399139 - protein, 4 aa, Plasmodium falciparum
GDLS

SEQ ID NO: 3399140 - protein, 10 aa, Plasmodium falciparum
GDNNNNNING

SEQ ID NO: 3399141 - protein, 12 aa, Plasmodium falciparum
GDNNSHGEEQNK

SEQ ID NO: 3399142 - protein, 15 aa, Plasmodium falciparum
GDNNTSYKNSNNNGW

SEQ ID NO: 3399143 - protein, 11 aa, Plasmodium falciparum
GDNVHKNDDEV

SEQ ID NO: 3399144 - protein, 11 aa, Plasmodium falciparum
GDNYQNIKDDT

SEQ ID NO: 3399145 - protein, 7 aa, Plasmodium falciparum
GDQNNVQ

SEQ ID NO: 3399146 - protein, 4 aa, Plasmodium falciparum
GDTP

SEQ ID NO: 3399147 - protein, 8 aa, Plasmodium falciparum
GDTSGDEK

SEQ ID NO: 3399148 - protein, 7 aa, Plasmodium falciparum
GDVPKEL

SEQ ID NO: 3399149 - protein, 7 aa, Plasmodium falciparum
GDYDDYD

SEQ ID NO: 3399150 - protein, 6 aa, Plasmodium falciparum
GEEKKA

SEQ ID NO: 3399151 - protein, 12 aa, Plasmodium falciparum
GEENITKNNNNI

SEQ ID NO: 3399152 - protein, 15 aa, Plasmodium falciparum
GEENMDNSKNEENHK

SEQ ID NO: 3399153 - protein, 10 aa, Plasmodium falciparum
GEEVKKNDDY

SEQ ID NO: 3399154 - protein, 17 aa, Plasmodium falciparum
GEGISGSLGTSSGNTLD

SEQ ID NO: 3399155 - protein, 5 aa, Plasmodium falciparum
GEGNF

SEQ ID NO: 3399156 - protein, 5 aa, Plasmodium falciparum
GEGRI

SEQ ID NO: 3399157 - protein, 14 aa, Plasmodium falciparum
GEITEDEVEEEKEE

SEQ ID NO: 3399158 - protein, 8 aa, Plasmodium falciparum
GEKEREHR

SEQ ID NO: 3399159 - protein, 7 aa, Plasmodium falciparum
GEKLEKS

SEQ ID NO: 3399160 - protein, 5 aa, Plasmodium falciparum
GEKYN

SEQ ID NO: 3399161 - protein, 14 aa, Plasmodium falciparum
GELKQQNYNVNEPR

SEQ ID NO: 3399162 - protein, 7 aa, Plasmodium falciparum
GENDELS

SEQ ID NO: 3399163 - protein, 21 aa, Plasmodium falciparum
GENEDNDDDNEEEEEKVSKNL

SEQ ID NO: 3399164 - protein, 7 aa, Plasmodium falciparum
GENETCT

SEQ ID NO: 3399165 - protein, 14 aa, Plasmodium falciparum
GENVNNKNCNEKNR

SEQ ID NO: 3399166 - protein, 11 aa, Plasmodium falciparum
GEQDESFEKSQ

SEQ ID NO: 3399167 - protein, 7 aa, Plasmodium falciparum
GEQSENN

SEQ ID NO: 3399168 - protein, 5 aa, Plasmodium falciparum
GETIQ

SEQ ID NO: 3399169 - protein, 12 aa, Plasmodium falciparum
GETKDTTENNKV

SEQ ID NO: 3399170 - protein, 7 aa, Plasmodium falciparum
GETREVA

SEQ ID NO: 3399171 - protein, 14 aa, Plasmodium falciparum
GEVDNDDQSYLDEE

SEQ ID NO: 3399172 - protein, 4 aa, Plasmodium falciparum
GFAD

SEQ ID NO: 3399173 - protein, 9 aa, Plasmodium falciparum
GFRTNRAPP

SEQ ID NO: 3399174 - protein, 10 aa, Plasmodium falciparum
GFSSNPEKNF

SEQ ID NO: 3399175 - protein, 4 aa, Plasmodium falciparum
GFTK

SEQ ID NO: 3399176 - protein, 14 aa, Plasmodium falciparum
GGAPTYKPENNKND

SEQ ID NO: 3399177 - protein, 4 aa, Plasmodium falciparum
GGCK

SEQ ID NO: 3399178 - protein, 4 aa, Plasmodium falciparum
GGDK

SEQ ID NO: 3399179 - protein, 7 aa, Plasmodium falciparum
GGEGDDV

SEQ ID NO: 3399180 - protein, 10 aa, Plasmodium falciparum
GGEGNIYSED

SEQ ID NO: 3399181 - protein, 5 aa, Plasmodium falciparum
GGEGT

SEQ ID NO: 3399182 - protein, 9 aa, Plasmodium falciparum
GGEKNRQNS

SEQ ID NO: 3399183 - protein, 7 aa, Plasmodium falciparum
GGKCRNN

SEQ ID NO: 3399184 - protein, 9 aa, Plasmodium falciparum
GGKLSPEVA

SEQ ID NO: 3399185 - protein, 9 aa, Plasmodium falciparum
GGKLSPKIA

SEQ ID NO: 3399186 - protein, 8 aa, Plasmodium falciparum
GGKLSSKI

SEQ ID NO: 3399187 - protein, 29 aa, Plasmodium falciparum
GGKNCNNGNFNHNNNNKAHEDDDNDDEDL

SEQ ID NO: 3399188 - protein, 8 aa, Plasmodium falciparum
GGKPSAHV

SEQ ID NO: 3399189 - protein, 10 aa, Plasmodium falciparum
GGLENYDGKG

SEQ ID NO: 3399190 - protein, 7 aa, Plasmodium falciparum
GGNREKN

SEQ ID NO: 3399191 - protein, 12 aa, Plasmodium falciparum
GGNVSEAQADEY

SEQ ID NO: 3399192 - protein, 6 aa, Plasmodium falciparum
GGQTPL

SEQ ID NO: 3399193 - protein, 5 aa, Plasmodium falciparum
GGSCS

SEQ ID NO: 3399194 - protein, 4 aa, Plasmodium falciparum
GGSN

SEQ ID NO: 3399195 - protein, 39 aa, Plasmodium falciparum
GGVKKERTDRYNVEDDNNKKDNDNKYNCNNNNNDDNKYD

SEQ ID NO: 3399196 - protein, 16 aa, Plasmodium falciparum
GHSGGSKNKAFGSVEK

SEQ ID NO: 3399197 - protein, 5 aa, Plasmodium falciparum
GHYQN

SEQ ID NO: 3399198 - protein, 6 aa, Plasmodium falciparum
GIDSFK

SEQ ID NO: 3399199 - protein, 5 aa, Plasmodium falciparum
GIETP

SEQ ID NO: 3399200 - protein, 4 aa, Plasmodium falciparum
GIKK

SEQ ID NO: 3399201 - protein, 4 aa, Plasmodium falciparum
GINE

SEQ ID NO: 3399202 - protein, 5 aa, Plasmodium falciparum
GINSN

SEQ ID NO: 3399203 - protein, 9 aa, Plasmodium falciparum
GIPPAQRGV

SEQ ID NO: 3399204 - protein, 5 aa, Plasmodium falciparum
GIPTL

SEQ ID NO: 3399205 - protein, 16 aa, Plasmodium falciparum
GITEDNYNDRLNDEDI

SEQ ID NO: 3399206 - protein, 10 aa, Plasmodium falciparum
GKAEGGTDAA

SEQ ID NO: 3399207 - protein, 6 aa, Plasmodium falciparum
GKCVPD

SEQ ID NO: 3399208 - protein, 10 aa, Plasmodium falciparum
GKDIEAATTG

SEQ ID NO: 3399209 - protein, 9 aa, Plasmodium falciparum
GKDNYSNYS

SEQ ID NO: 3399210 - protein, 5 aa, Plasmodium falciparum
GKEIN

SEQ ID NO: 3399211 - protein, 6 aa, Plasmodium falciparum
GKENDY

SEQ ID NO: 3399212 - protein, 13 aa, Plasmodium falciparum
GKEPNRGINPDEA

SEQ ID NO: 3399213 - protein, 6 aa, Plasmodium falciparum
GKGETC

SEQ ID NO: 3399214 - protein, 15 aa, Plasmodium falciparum
GKGIESQSYKEIRND

SEQ ID NO: 3399215 - protein, 8 aa, Plasmodium falciparum
GKGKRSGV

SEQ ID NO: 3399216 - protein, 6 aa, Plasmodium falciparum
GKGNYA

SEQ ID NO: 3399217 - protein, 9 aa, Plasmodium falciparum
GKGTRSRKR

SEQ ID NO: 3399218 - protein, 9 aa, Plasmodium falciparum
GKINEQDVD

SEQ ID NO: 3399219 - protein, 10 aa, Plasmodium falciparum
GKKAPSDPQC

SEQ ID NO: 3399220 - protein, 8 aa, Plasmodium falciparum
GKKKPLKK

SEQ ID NO: 3399221 - protein, 8 aa, Plasmodium falciparum
GKKSSEIN

SEQ ID NO: 3399222 - protein, 6 aa, Plasmodium falciparum
GKLSAQ

SEQ ID NO: 3399223 - protein, 11 aa, Plasmodium falciparum
GKLSDTKGNVA

SEQ ID NO: 3399224 - protein, 7 aa, Plasmodium falciparum
GKLSPRI

SEQ ID NO: 3399225 - protein, 7 aa, Plasmodium falciparum
GKNDQIN

SEQ ID NO: 3399226 - protein, 8 aa, Plasmodium falciparum
GKNKINNN

SEQ ID NO: 3399227 - protein, 7 aa, Plasmodium falciparum
GKNKSTL

SEQ ID NO: 3399228 - protein, 7 aa, Plasmodium falciparum
GKPSKYE

SEQ ID NO: 3399229 - protein, 9 aa, Plasmodium falciparum
GKSEKKGKV

SEQ ID NO: 3399230 - protein, 9 aa, Plasmodium falciparum
GKSPSYDIT

SEQ ID NO: 3399231 - protein, 5 aa, Plasmodium falciparum
GKSSF

SEQ ID NO: 3399232 - protein, 4 aa, Plasmodium falciparum
GKTK

SEQ ID NO: 3399233 - protein, 9 aa, Plasmodium falciparum
GKTKNIKKK

SEQ ID NO: 3399234 - protein, 5 aa, Plasmodium falciparum
GKTNS

SEQ ID NO: 3399235 - protein, 7 aa, Plasmodium falciparum
GKTTTTE

SEQ ID NO: 3399236 - protein, 8 aa, Plasmodium falciparum
GKVEENLD

SEQ ID NO: 3399237 - protein, 5 aa, Plasmodium falciparum
GKVTK

SEQ ID NO: 3399238 - protein, 19 aa, Plasmodium falciparum
GKYSYGSVEPITGNIISTM

SEQ ID NO: 3399239 - protein, 11 aa, Plasmodium falciparum
GLGEKTNDVPK

SEQ ID NO: 3399240 - protein, 4 aa, Plasmodium falciparum
GLGN

SEQ ID NO: 3399241 - protein, 18 aa, Plasmodium falciparum
GLNDKNETSEKKVEENIK

SEQ ID NO: 3399242 - protein, 18 aa, Plasmodium falciparum
GLNNNNNTSDDQDQNDYQ

SEQ ID NO: 3399243 - protein, 9 aa, Plasmodium falciparum
GLSKEQDVD

SEQ ID NO: 3399244 - protein, 113 aa, Plasmodium falciparum
GLSPNSMGTSANISPQNSMTTPNNTSDTKGVSSSNTLSSPNTLSSSNRLSSPNTLSSPNTLSSSNRLSSPNTLSSSNTLPSSNTLSSSNTLSSSNTLSSPNTLSSSNTFSSAP

SEQ ID NO: 3399245 - protein, 5 aa, Plasmodium falciparum
GMKNN

SEQ ID NO: 3399246 - protein, 10 aa, Plasmodium falciparum
GMPIKNSNKF

SEQ ID NO: 3399247 - protein, 6 aa, Plasmodium falciparum
GNCPKD

SEQ ID NO: 3399248 - protein, 9 aa, Plasmodium falciparum
GNDCPEPEK

SEQ ID NO: 3399249 - protein, 5 aa, Plasmodium falciparum
GNDNA

SEQ ID NO: 3399250 - protein, 17 aa, Plasmodium falciparum
GNDYSDKDSYNKNMNDK

SEQ ID NO: 3399251 - protein, 11 aa, Plasmodium falciparum
GNHKCSEEEIK

SEQ ID NO: 3399252 - protein, 8 aa, Plasmodium falciparum
GNHSNDEE

SEQ ID NO: 3399253 - protein, 13 aa, Plasmodium falciparum
GNIESIKTNDEPI

SEQ ID NO: 3399254 - protein, 9 aa, Plasmodium falciparum
GNKDNKKEM

SEQ ID NO: 3399255 - protein, 5 aa, Plasmodium falciparum
GNKED

SEQ ID NO: 3399256 - protein, 32 aa, Plasmodium falciparum
GNKNPQKRERKNEEENQKDNTKVDNDNNMGNE

SEQ ID NO: 3399257 - protein, 16 aa, Plasmodium falciparum
GNKQNNDSTNHQDIEK

SEQ ID NO: 3399258 - protein, 27 aa, Plasmodium falciparum
GNLSTSNPLPTQQNSLSSTNTNNSNIS

SEQ ID NO: 3399259 - protein, 20 aa, Plasmodium falciparum
GNNIRNNKGTELKYNDDENM

SEQ ID NO: 3399260 - protein, 5 aa, Plasmodium falciparum
GNNKG

SEQ ID NO: 3399261 - protein, 15 aa, Plasmodium falciparum
GNNNINEIQNDDNYN

SEQ ID NO: 3399262 - protein, 13 aa, Plasmodium falciparum
GNNNKNIKNKNNY

SEQ ID NO: 3399263 - protein, 14 aa, Plasmodium falciparum
GNNNNNNAGSESDV

SEQ ID NO: 3399264 - protein, 7 aa, Plasmodium falciparum
GNNNSNG

SEQ ID NO: 3399265 - protein, 5 aa, Plasmodium falciparum
GNNPL

SEQ ID NO: 3399266 - protein, 9 aa, Plasmodium falciparum
GNNPSSDDI

SEQ ID NO: 3399267 - protein, 40 aa, Plasmodium falciparum
GNNTFKNDEKYNENDYKNNHDDDKKKYTDDSNEENIYEER

SEQ ID NO: 3399268 - protein, 6 aa, Plasmodium falciparum
GNNVEE

SEQ ID NO: 3399269 - protein, 9 aa, Plasmodium falciparum
GNPGTGKTT

SEQ ID NO: 3399270 - protein, 6 aa, Plasmodium falciparum
GNPPQT

SEQ ID NO: 3399271 - protein, 11 aa, Plasmodium falciparum
GNQENVDRNNS

SEQ ID NO: 3399272 - protein, 4 aa, Plasmodium falciparum
GNQK

SEQ ID NO: 3399273 - protein, 4 aa, Plasmodium falciparum
GNQN

SEQ ID NO: 3399274 - protein, 15 aa, Plasmodium falciparum
GNRDASSLVNKDDPS

SEQ ID NO: 3399275 - protein, 11 aa, Plasmodium falciparum
GNSETEQKERK

SEQ ID NO: 3399276 - protein, 4 aa, Plasmodium falciparum
GNSS

SEQ ID NO: 3399277 - protein, 10 aa, Plasmodium falciparum
GNTHLGGEDF

SEQ ID NO: 3399278 - protein, 13 aa, Plasmodium falciparum
GNVDESMGRNGSI

SEQ ID NO: 3399279 - protein, 5 aa, Plasmodium falciparum
GNVQN

SEQ ID NO: 3399280 - protein, 7 aa, Plasmodium falciparum
GPANRSK

SEQ ID NO: 3399281 - protein, 4 aa, Plasmodium falciparum
GPCD

SEQ ID NO: 3399282 - protein, 5 aa, Plasmodium falciparum
GPIEK

SEQ ID NO: 3399283 - protein, 4 aa, Plasmodium falciparum
GPMN

SEQ ID NO: 3399284 - protein, 5 aa, Plasmodium falciparum
GPPTC

SEQ ID NO: 3399285 - protein, 4 aa, Plasmodium falciparum
GPRG

SEQ ID NO: 3399286 - protein, 5 aa, Plasmodium falciparum
GPSDC

SEQ ID NO: 3399287 - protein, 5 aa, Plasmodium falciparum
GPSGF

SEQ ID NO: 3399288 - protein, 5 aa, Plasmodium falciparum
GPSTC

SEQ ID NO: 3399289 - protein, 12 aa, Plasmodium falciparum
GPVDNTTGKVIY

SEQ ID NO: 3399290 - protein, 15 aa, Plasmodium falciparum
GPVEESGNVMNITYR

SEQ ID NO: 3399291 - protein, 7 aa, Plasmodium falciparum
GQDEKSV

SEQ ID NO: 3399292 - protein, 32 aa, Plasmodium falciparum
GQEEFKGSTQNNVESFSSNNHSRSITFNKHME

SEQ ID NO: 3399293 - protein, 29 aa, Plasmodium falciparum
GQEESTSEQLPSSLSSPQNNKQSERSKEK

SEQ ID NO: 3399294 - protein, 495 aa, Plasmodium falciparum
GQEGVEQETHGSEDEVSNGREDKVSNGGEDEVSNGGEDEVSNGREDKVSNGGEDEVSNGREDKVSNGGEDEVSNGREDKVSNGGEDEVSNGREDKVSNGGEDEVSNGREDKVSNGREDKVSNGGEDEVSNGREDKVSNGREDKVSNGGEDEVSNGREDKVSNGGEDEVSNGREDKVSNGGEDEVSNGREDKVSNGREDEVSNGREDKVSNGGEDEVSNGREDKVSNGGEDEVSNGREDKVSNGREDKVSNGGEDEVSNGREDKVSNGGEDEVSNGREDKVSNGREDKVSNGREDEVSNGREDKVSNGGEDEVSNGREDKVSNGREDKVSNGGEDEVSNGREDKVSNGGEDEVSNGREDKVSNGREDKVSNGREDKVSNGGEDEVSNGGEDEVSNGREDKVSNGGEDEVSNGREDKVSNGGEDEVSNGREDKVSNGGEDEVSNGREDKVSNGREDEVSNGREDKGGAGTDGELSHNSESHTKNKKSKNSIINMLIG

SEQ ID NO: 3399295 - protein, 4 aa, Plasmodium falciparum
GQER

SEQ ID NO: 3399296 - protein, 6 aa, Plasmodium falciparum
GQESAT

SEQ ID NO: 3399297 - protein, 16 aa, Plasmodium falciparum
GQGKHINKSSHNKGGI

SEQ ID NO: 3399298 - protein, 9 aa, Plasmodium falciparum
GQIDSDKDG

SEQ ID NO: 3399299 - protein, 9 aa, Plasmodium falciparum
GQNNDSHFE

SEQ ID NO: 3399300 - protein, 20 aa, Plasmodium falciparum
GQPGGPSPQPSGDEDVDSDE

SEQ ID NO: 3399301 - protein, 19 aa, Plasmodium falciparum
GQSSSNSDDTVSSSDSRGV

SEQ ID NO: 3399302 - protein, 8 aa, Plasmodium falciparum
GRDCTTQR

SEQ ID NO: 3399303 - protein, 7 aa, Plasmodium falciparum
GRDRAQR

SEQ ID NO: 3399304 - protein, 14 aa, Plasmodium falciparum
GRFSSEKPNLQQIP

SEQ ID NO: 3399305 - protein, 11 aa, Plasmodium falciparum
GRKGFDDDNNG

SEQ ID NO: 3399306 - protein, 5 aa, Plasmodium falciparum
GRNRK

SEQ ID NO: 3399307 - protein, 10 aa, Plasmodium falciparum
GRPNPKQTND

SEQ ID NO: 3399308 - protein, 9 aa, Plasmodium falciparum
GRSGERKYG

SEQ ID NO: 3399309 - protein, 23 aa, Plasmodium falciparum
GSAGGSTDVNSSNSSANDEQSYD

SEQ ID NO: 3399310 - protein, 5 aa, Plasmodium falciparum
GSCDE

SEQ ID NO: 3399311 - protein, 8 aa, Plasmodium falciparum
GSDIPEKC

SEQ ID NO: 3399312 - protein, 9 aa, Plasmodium falciparum
GSGEGSLDA

SEQ ID NO: 3399313 - protein, 5 aa, Plasmodium falciparum
GSGKT

SEQ ID NO: 3399314 - protein, 4 aa, Plasmodium falciparum
GSGN

SEQ ID NO: 3399315 - protein, 7 aa, Plasmodium falciparum
GSIGKKQ

SEQ ID NO: 3399316 - protein, 5 aa, Plasmodium falciparum
GSIHN

SEQ ID NO: 3399317 - protein, 9 aa, Plasmodium falciparum
GSISPSGGE

SEQ ID NO: 3399318 - protein, 6 aa, Plasmodium falciparum
GSISSG

SEQ ID NO: 3399319 - protein, 7 aa, Plasmodium falciparum
GSITPKS

SEQ ID NO: 3399320 - protein, 4 aa, Plasmodium falciparum
GSKP

SEQ ID NO: 3399321 - protein, 13 aa, Plasmodium falciparum
GSLHEKKTKEILG

SEQ ID NO: 3399322 - protein, 5 aa, Plasmodium falciparum
GSLVD

SEQ ID NO: 3399323 - protein, 4 aa, Plasmodium falciparum
GSMG

SEQ ID NO: 3399324 - protein, 14 aa, Plasmodium falciparum
GSNIGDGQNTSSSC

SEQ ID NO: 3399325 - protein, 17 aa, Plasmodium falciparum
GSNSCTSKQGSSNKYDT

SEQ ID NO: 3399326 - protein, 9 aa, Plasmodium falciparum
GSPTGKQEI

SEQ ID NO: 3399327 - protein, 5 aa, Plasmodium falciparum
GSQKK

SEQ ID NO: 3399328 - protein, 17 aa, Plasmodium falciparum
GSQNTEGESEVPSDDEI

SEQ ID NO: 3399329 - protein, 8 aa, Plasmodium falciparum
GSQSRNRD

SEQ ID NO: 3399330 - protein, 11 aa, Plasmodium falciparum
GSRGTYSDNSS

SEQ ID NO: 3399331 - protein, 6 aa, Plasmodium falciparum
GSSFEM

SEQ ID NO: 3399332 - protein, 4 aa, Plasmodium falciparum
GSSY

SEQ ID NO: 3399333 - protein, 8 aa, Plasmodium falciparum
GSTGVGKT

SEQ ID NO: 3399334 - protein, 7 aa, Plasmodium falciparum
GSTKNVE

SEQ ID NO: 3399335 - protein, 6 aa, Plasmodium falciparum
GSTKNY

SEQ ID NO: 3399336 - protein, 4 aa, Plasmodium falciparum
GSTQ

SEQ ID NO: 3399337 - protein, 10 aa, Plasmodium falciparum
GSYEEEEDEL

SEQ ID NO: 3399338 - protein, 7 aa, Plasmodium falciparum
GTANNNI

SEQ ID NO: 3399339 - protein, 8 aa, Plasmodium falciparum
GTDSGEPL

SEQ ID NO: 3399340 - protein, 5 aa, Plasmodium falciparum
GTGFS

SEQ ID NO: 3399341 - protein, 5 aa, Plasmodium falciparum
GTKEE

SEQ ID NO: 3399342 - protein, 9 aa, Plasmodium falciparum
GTKKKSEKV

SEQ ID NO: 3399343 - protein, 5 aa, Plasmodium falciparum
GTKNN

SEQ ID NO: 3399344 - protein, 7 aa, Plasmodium falciparum
GTLNETP

SEQ ID NO: 3399345 - protein, 12 aa, Plasmodium falciparum
GTLSENIESAEE

SEQ ID NO: 3399346 - protein, 6 aa, Plasmodium falciparum
GTNYNG

SEQ ID NO: 3399347 - protein, 7 aa, Plasmodium falciparum
GTQEEQG

SEQ ID NO: 3399348 - protein, 5 aa, Plasmodium falciparum
GTTNI

SEQ ID NO: 3399349 - protein, 9 aa, Plasmodium falciparum
GVEPTEDSN

SEQ ID NO: 3399350 - protein, 6 aa, Plasmodium falciparum
GVGKTE

SEQ ID NO: 3399351 - protein, 14 aa, Plasmodium falciparum
GVNHSEEKYEDLDD

SEQ ID NO: 3399352 - protein, 57 aa, Plasmodium falciparum
GVNKKGETKNEEVEKEENENEEIEKEEIENEENQQNEEDENEENQQNEEDENEENQQ

SEQ ID NO: 3399353 - protein, 19 aa, Plasmodium falciparum
GVNNGKNKIKEGSKDGINK

SEQ ID NO: 3399354 - protein, 4 aa, Plasmodium falciparum
GVPA

SEQ ID NO: 3399355 - protein, 10 aa, Plasmodium falciparum
GVPEHKKEEN

SEQ ID NO: 3399356 - protein, 11 aa, Plasmodium falciparum
GVRNKSENRTP

SEQ ID NO: 3399357 - protein, 7 aa, Plasmodium falciparum
GYGSKTK

SEQ ID NO: 3399358 - protein, 4 aa, Plasmodium falciparum
GYKN

SEQ ID NO: 3399359 - protein, 11 aa, Plasmodium falciparum
GYNDNPKKGCR

SEQ ID NO: 3399360 - protein, 8 aa, Plasmodium falciparum
GYSSNNYQ

SEQ ID NO: 3399361 - protein, 5 aa, Plasmodium falciparum
HAADA

SEQ ID NO: 3399362 - protein, 31 aa, Plasmodium falciparum
HAATSKRKRHSTNERGYDTFSSPSYKTYSKS

SEQ ID NO: 3399363 - protein, 4 aa, Plasmodium falciparum
HANL

SEQ ID NO: 3399364 - protein, 60 aa, Plasmodium falciparum
HATATTNESTHNEHATTTTNEPTHNEHSTTPTNESTHSENATTSTNEQHSHDQNTEVHPN

SEQ ID NO: 3399365 - protein, 6 aa, Plasmodium falciparum
HATTPS

SEQ ID NO: 3399366 - protein, 14 aa, Plasmodium falciparum
HATTTTNEPTHNEH

SEQ ID NO: 3399367 - protein, 6 aa, Plasmodium falciparum
HCSNNN

SEQ ID NO: 3399368 - protein, 13 aa, Plasmodium falciparum
HDASTTDSNAMDV

SEQ ID NO: 3399369 - protein, 74 aa, Plasmodium falciparum
HDDAHHDGAHHDDAHHDGAHHDDAHHDGAHHDDAHHDGAHHDDAHHDGAHHDGAHHDGAHHDGAHHNATTHHLH

SEQ ID NO: 3399370 - protein, 58 aa, Plasmodium falciparum
HDDEDTDEDDEEDEDDEDDEDDEDDDDYDDEDEEDEEDEEDEDDEDDEDSMNDGYNYD

SEQ ID NO: 3399371 - protein, 5 aa, Plasmodium falciparum
HDDSR

SEQ ID NO: 3399372 - protein, 34 aa, Plasmodium falciparum
HDEQRVRDEGRENNRRSSVPNNAHTSAKYYGSDQ

SEQ ID NO: 3399373 - protein, 10 aa, Plasmodium falciparum
HDGGKNSIID

SEQ ID NO: 3399374 - protein, 36 aa, Plasmodium falciparum
HDIESRNKRVNEYEDECENDNNNNNNNNDDDDGEER

SEQ ID NO: 3399375 - protein, 13 aa, Plasmodium falciparum
HDKNARSKQRKNQ

SEQ ID NO: 3399376 - protein, 9 aa, Plasmodium falciparum
HDKNPAEDF

SEQ ID NO: 3399377 - protein, 9 aa, Plasmodium falciparum
HDKNRYNKN

SEQ ID NO: 3399378 - protein, 8 aa, Plasmodium falciparum
HDPTTSKE

SEQ ID NO: 3399379 - protein, 9 aa, Plasmodium falciparum
HDTMQKDDK

SEQ ID NO: 3399380 - protein, 22 aa, Plasmodium falciparum
HEQKEENEKLNGPLTNEGKIYK

SEQ ID NO: 3399381 - protein, 15 aa, Plasmodium falciparum
HERPSELPSDSIQVN

SEQ ID NO: 3399382 - protein, 5 aa, Plasmodium falciparum
HESGA

SEQ ID NO: 3399383 - protein, 7 aa, Plasmodium falciparum
HESRGRW

SEQ ID NO: 3399384 - protein, 16 aa, Plasmodium falciparum
HETPPYKSDLEEDKRY

SEQ ID NO: 3399385 - protein, 18 aa, Plasmodium falciparum
HFGSNSSEDKTNKKSSIN

SEQ ID NO: 3399386 - protein, 56 aa, Plasmodium falciparum
HGDNINHGDNINHGDNINHGDNINHGDNINHGDNINHGDNINHGDNINHGDNLSGH

SEQ ID NO: 3399387 - protein, 9 aa, Plasmodium falciparum
HGDSKHTEN

SEQ ID NO: 3399388 - protein, 23 aa, Plasmodium falciparum
HGENIDEMNEKSEYDSSVPSYLN

SEQ ID NO: 3399389 - protein, 6 aa, Plasmodium falciparum
HGGPYA

SEQ ID NO: 3399390 - protein, 6 aa, Plasmodium falciparum
HGGTLD

SEQ ID NO: 3399391 - protein, 43 aa, Plasmodium falciparum
HGQSGETEVQPSQLRSTANQDSNRGAVTSDPLRTQPETTSTSV

SEQ ID NO: 3399392 - protein, 5 aa, Plasmodium falciparum
HGSCS

SEQ ID NO: 3399393 - protein, 10 aa, Plasmodium falciparum
HGTSTNLNDK

SEQ ID NO: 3399394 - protein, 5 aa, Plasmodium falciparum
HHATD

SEQ ID NO: 3399395 - protein, 6 aa, Plasmodium falciparum
HHATDA

SEQ ID NO: 3399396 - protein, 13 aa, Plasmodium falciparum
HIENRKSKNKVNR

SEQ ID NO: 3399397 - protein, 26 aa, Plasmodium falciparum
HINTNKPSTPTSSHNNTKEKERTEED

SEQ ID NO: 3399398 - protein, 7 aa, Plasmodium falciparum
HKDNDID

SEQ ID NO: 3399399 - protein, 5 aa, Plasmodium falciparum
HKEED

SEQ ID NO: 3399400 - protein, 5 aa, Plasmodium falciparum
HKEEN

SEQ ID NO: 3399401 - protein, 10 aa, Plasmodium falciparum
HKEQKYCNST

SEQ ID NO: 3399402 - protein, 12 aa, Plasmodium falciparum
HKERPNKKCSNR

SEQ ID NO: 3399403 - protein, 8 aa, Plasmodium falciparum
HKINPNQN

SEQ ID NO: 3399404 - protein, 8 aa, Plasmodium falciparum
HKKEDDNI

SEQ ID NO: 3399405 - protein, 6 aa, Plasmodium falciparum
HKNLKT

SEQ ID NO: 3399406 - protein, 8 aa, Plasmodium falciparum
HKNNNKRK

SEQ ID NO: 3399407 - protein, 14 aa, Plasmodium falciparum
HKNTLDPNKSTVNR

SEQ ID NO: 3399408 - protein, 9 aa, Plasmodium falciparum
HKQENNNSF

SEQ ID NO: 3399409 - protein, 22 aa, Plasmodium falciparum
HKSRDENINSNNNDEDMNNTNT

SEQ ID NO: 3399410 - protein, 8 aa, Plasmodium falciparum
HKSSSGSC

SEQ ID NO: 3399411 - protein, 5 aa, Plasmodium falciparum
HLGTP

SEQ ID NO: 3399412 - protein, 10 aa, Plasmodium falciparum
HNDFEKSKKE

SEQ ID NO: 3399413 - protein, 6 aa, Plasmodium falciparum
HNDKNN

SEQ ID NO: 3399414 - protein, 5 aa, Plasmodium falciparum
HNDNE

SEQ ID NO: 3399415 - protein, 8 aa, Plasmodium falciparum
HNEENLKK

SEQ ID NO: 3399416 - protein, 15 aa, Plasmodium falciparum
HNKIEESNQTKSPLR

SEQ ID NO: 3399417 - protein, 10 aa, Plasmodium falciparum
HNKNEEKIDE

SEQ ID NO: 3399418 - protein, 12 aa, Plasmodium falciparum
HNKNFNEKENRE

SEQ ID NO: 3399419 - protein, 8 aa, Plasmodium falciparum
HNKNNNNK

SEQ ID NO: 3399420 - protein, 25 aa, Plasmodium falciparum
HNKQPQGKQGQQGGAPLPNLGEEEN

SEQ ID NO: 3399421 - protein, 4 aa, Plasmodium falciparum
HNND

SEQ ID NO: 3399422 - protein, 23 aa, Plasmodium falciparum
HNNEKKEFKDSQNHNEDKEHNNI

SEQ ID NO: 3399423 - protein, 10 aa, Plasmodium falciparum
HNNKKEVEKF

SEQ ID NO: 3399424 - protein, 30 aa, Plasmodium falciparum
HNNKSYDGGISNSREQNNDENYMREEQRGN

SEQ ID NO: 3399425 - protein, 28 aa, Plasmodium falciparum
HNNNEKVKRTKKKINDAPYDKQDEELPS

SEQ ID NO: 3399426 - protein, 9 aa, Plasmodium falciparum
HNNQNDDTT

SEQ ID NO: 3399427 - protein, 17 aa, Plasmodium falciparum
HNQQLAEGGNIKDTPSY

SEQ ID NO: 3399428 - protein, 8 aa, Plasmodium falciparum
HPDNGGST

SEQ ID NO: 3399429 - protein, 6 aa, Plasmodium falciparum
HPGEST

SEQ ID NO: 3399430 - protein, 7 aa, Plasmodium falciparum
HPHGDKS

SEQ ID NO: 3399431 - protein, 10 aa, Plasmodium falciparum
HPNDMNGSAK

SEQ ID NO: 3399432 - protein, 4 aa, Plasmodium falciparum
HPNF

SEQ ID NO: 3399433 - protein, 7 aa, Plasmodium falciparum
HRAQADR

SEQ ID NO: 3399434 - protein, 24 aa, Plasmodium falciparum
HRKDDDYEKNEDIHSNSHSDKNSN

SEQ ID NO: 3399435 - protein, 36 aa, Plasmodium falciparum
HRRGNSNCSNTNNNKDNKDNYGNYGNYDNYDNNNNN

SEQ ID NO: 3399436 - protein, 5 aa, Plasmodium falciparum
HSGCE

SEQ ID NO: 3399437 - protein, 10 aa, Plasmodium falciparum
HSIDPEKHEE

SEQ ID NO: 3399438 - protein, 8 aa, Plasmodium falciparum
HSLADPDE

SEQ ID NO: 3399439 - protein, 5 aa, Plasmodium falciparum
HSSEN

SEQ ID NO: 3399440 - protein, 4 aa, Plasmodium falciparum
HSTG

SEQ ID NO: 3399441 - protein, 6 aa, Plasmodium falciparum
HTDDDE

SEQ ID NO: 3399442 - protein, 13 aa, Plasmodium falciparum
HTDDNKDHSDIYP

SEQ ID NO: 3399443 - protein, 15 aa, Plasmodium falciparum
HTGNPNQYGKSPPKI

SEQ ID NO: 3399444 - protein, 10 aa, Plasmodium falciparum
HTKHEEKNLQ

SEQ ID NO: 3399445 - protein, 6 aa, Plasmodium falciparum
HTNKDE

SEQ ID NO: 3399446 - protein, 6 aa, Plasmodium falciparum
HTTTNN

SEQ ID NO: 3399447 - protein, 7 aa, Plasmodium falciparum
HYSQSEK

SEQ ID NO: 3399448 - protein, 7 aa, Plasmodium falciparum
IAGPARS

SEQ ID NO: 3399449 - protein, 8 aa, Plasmodium falciparum
IAKSGTSN

SEQ ID NO: 3399450 - protein, 18 aa, Plasmodium falciparum
IASSGGSSLTPSNSLLPP

SEQ ID NO: 3399451 - protein, 10 aa, Plasmodium falciparum
IDDNADDELT

SEQ ID NO: 3399452 - protein, 4 aa, Plasmodium falciparum
IDDQ

SEQ ID NO: 3399453 - protein, 9 aa, Plasmodium falciparum
IDEDSKEKK

SEQ ID NO: 3399454 - protein, 8 aa, Plasmodium falciparum
IDENNQIQ

SEQ ID NO: 3399455 - protein, 11 aa, Plasmodium falciparum
IDHNDNDNDNL

SEQ ID NO: 3399456 - protein, 55 aa, Plasmodium falciparum
IDKAENDLKKSTSVNTTFTPKNVPNTEQNDQETQTDDDINDSDIDENNNTNDKNN

SEQ ID NO: 3399457 - protein, 7 aa, Plasmodium falciparum
IDKKGYK

SEQ ID NO: 3399458 - protein, 4 aa, Plasmodium falciparum
IDKN

SEQ ID NO: 3399459 - protein, 23 aa, Plasmodium falciparum
IDKNQNNNRNNNNNNDNNNNNNN

SEQ ID NO: 3399460 - protein, 9 aa, Plasmodium falciparum
IDPNGKKET

SEQ ID NO: 3399461 - protein, 14 aa, Plasmodium falciparum
IDSTKLEGTYGENL

SEQ ID NO: 3399462 - protein, 19 aa, Plasmodium falciparum
IDTSKKSSYKKKSKGKNDG

SEQ ID NO: 3399463 - protein, 12 aa, Plasmodium falciparum
IEDENDSSKFEE

SEQ ID NO: 3399464 - protein, 5 aa, Plasmodium falciparum
IEDTL

SEQ ID NO: 3399465 - protein, 4 aa, Plasmodium falciparum
IEEQ

SEQ ID NO: 3399466 - protein, 5 aa, Plasmodium falciparum
IEGAH

SEQ ID NO: 3399467 - protein, 4 aa, Plasmodium falciparum
IEGN

SEQ ID NO: 3399468 - protein, 9 aa, Plasmodium falciparum
IEKPQQNNM

SEQ ID NO: 3399469 - protein, 20 aa, Plasmodium falciparum
IEKPTQDETDNSNEENKSKL

SEQ ID NO: 3399470 - protein, 4 aa, Plasmodium falciparum
IEKY

SEQ ID NO: 3399471 - protein, 27 aa, Plasmodium falciparum
IENEEKSNGSRKSSNKQKYNESDKRED

SEQ ID NO: 3399472 - protein, 11 aa, Plasmodium falciparum
IENKENIKNKE

SEQ ID NO: 3399473 - protein, 12 aa, Plasmodium falciparum
IENSDISSEEKE

SEQ ID NO: 3399474 - protein, 8 aa, Plasmodium falciparum
IEPKNDGV

SEQ ID NO: 3399475 - protein, 4 aa, Plasmodium falciparum
IESD

SEQ ID NO: 3399476 - protein, 16 aa, Plasmodium falciparum
IESENGNKKKDDNVKN

SEQ ID NO: 3399477 - protein, 5 aa, Plasmodium falciparum
IESIQ

SEQ ID NO: 3399478 - protein, 19 aa, Plasmodium falciparum
IESPNEELKKSCEDDNDKE

SEQ ID NO: 3399479 - protein, 4 aa, Plasmodium falciparum
IEYD

SEQ ID NO: 3399480 - protein, 18 aa, Plasmodium falciparum
IGDNKNSDISKDSPIDKH

SEQ ID NO: 3399481 - protein, 6 aa, Plasmodium falciparum
IGEKYD

SEQ ID NO: 3399482 - protein, 4 aa, Plasmodium falciparum
IGEN

SEQ ID NO: 3399483 - protein, 5 aa, Plasmodium falciparum
IGGNN

SEQ ID NO: 3399484 - protein, 7 aa, Plasmodium falciparum
IGNEKPS

SEQ ID NO: 3399485 - protein, 4 aa, Plasmodium falciparum
IGNP

SEQ ID NO: 3399486 - protein, 34 aa, Plasmodium falciparum
IGPKDDNTEDKNKEKCKNVSNNKNLNSTNTNNNM

SEQ ID NO: 3399487 - protein, 5 aa, Plasmodium falciparum
IGPNA

SEQ ID NO: 3399488 - protein, 6 aa, Plasmodium falciparum
IGQNKR

SEQ ID NO: 3399489 - protein, 79 aa, Plasmodium falciparum
IGTHDEKKKKCDNTKNNRNNNDDNDDNDNDNDNNNDNNNDNNNNNNNNNNNNNNNNNNNNNNSNSNSCDNNNKRDNDSF

SEQ ID NO: 3399490 - protein, 63 aa, Plasmodium falciparum
IGTKQNGKYDNNENNNNNENNNNNENNNNNNENNNNNNENNNSNNENNNSNNENNNSNNNKHC

SEQ ID NO: 3399491 - protein, 16 aa, Plasmodium falciparum
IHSDNKNNVNNDNIND

SEQ ID NO: 3399492 - protein, 4 aa, Plasmodium falciparum
IIKN

SEQ ID NO: 3399493 - protein, 12 aa, Plasmodium falciparum
IKDNNNHSTNDY

SEQ ID NO: 3399494 - protein, 8 aa, Plasmodium falciparum
IKDPNKPI

SEQ ID NO: 3399495 - protein, 14 aa, Plasmodium falciparum
IKEEEQNKKLDSET

SEQ ID NO: 3399496 - protein, 8 aa, Plasmodium falciparum
IKEGDPPR

SEQ ID NO: 3399497 - protein, 10 aa, Plasmodium falciparum
IKENEDDNKN

SEQ ID NO: 3399498 - protein, 8 aa, Plasmodium falciparum
IKGNSEEF

SEQ ID NO: 3399499 - protein, 38 aa, Plasmodium falciparum
IKGNSEENSENQQKSSKSQSLQSNEPNKLNQENISPVQ

SEQ ID NO: 3399500 - protein, 6 aa, Plasmodium falciparum
IKIQQE

SEQ ID NO: 3399501 - protein, 16 aa, Plasmodium falciparum
IKKGTTESDTSSSTCV

SEQ ID NO: 3399502 - protein, 11 aa, Plasmodium falciparum
IKKKDEQKKEF

SEQ ID NO: 3399503 - protein, 16 aa, Plasmodium falciparum
IKKNETTAYDNNYDNN

SEQ ID NO: 3399504 - protein, 4 aa, Plasmodium falciparum
IKKR

SEQ ID NO: 3399505 - protein, 4 aa, Plasmodium falciparum
IKND

SEQ ID NO: 3399506 - protein, 7 aa, Plasmodium falciparum
IKNDKDN

SEQ ID NO: 3399507 - protein, 8 aa, Plasmodium falciparum
IKNDTDQC

SEQ ID NO: 3399508 - protein, 13 aa, Plasmodium falciparum
IKNEDNDNTKENV

SEQ ID NO: 3399509 - protein, 10 aa, Plasmodium falciparum
IKNEKSDKKK

SEQ ID NO: 3399510 - protein, 5 aa, Plasmodium falciparum
IKNGR

SEQ ID NO: 3399511 - protein, 5 aa, Plasmodium falciparum
IKNKG

SEQ ID NO: 3399512 - protein, 4 aa, Plasmodium falciparum
IKNM

SEQ ID NO: 3399513 - protein, 11 aa, Plasmodium falciparum
IKNNENENENV

SEQ ID NO: 3399514 - protein, 12 aa, Plasmodium falciparum
IKNNERKNTLKI

SEQ ID NO: 3399515 - protein, 17 aa, Plasmodium falciparum
IKNNKNESVNQIKESKK

SEQ ID NO: 3399516 - protein, 10 aa, Plasmodium falciparum
IKNNSNNINS

SEQ ID NO: 3399517 - protein, 21 aa, Plasmodium falciparum
IKNPIDNSNISNLDKSNDTNN

SEQ ID NO: 3399518 - protein, 7 aa, Plasmodium falciparum
IKNQKST

SEQ ID NO: 3399519 - protein, 4 aa, Plasmodium falciparum
IKNV

SEQ ID NO: 3399520 - protein, 6 aa, Plasmodium falciparum
IKPNDE

SEQ ID NO: 3399521 - protein, 9 aa, Plasmodium falciparum
IKPNNHKRT

SEQ ID NO: 3399522 - protein, 5 aa, Plasmodium falciparum
IKQEK

SEQ ID NO: 3399523 - protein, 5 aa, Plasmodium falciparum
IKQEN

SEQ ID NO: 3399524 - protein, 9 aa, Plasmodium falciparum
IKQSESEIN

SEQ ID NO: 3399525 - protein, 4 aa, Plasmodium falciparum
IKRN

SEQ ID NO: 3399526 - protein, 4 aa, Plasmodium falciparum
IKSN

SEQ ID NO: 3399527 - protein, 11 aa, Plasmodium falciparum
IKSNGDKTSEL

SEQ ID NO: 3399528 - protein, 6 aa, Plasmodium falciparum
IKTGTK

SEQ ID NO: 3399529 - protein, 5 aa, Plasmodium falciparum
IKTKG

SEQ ID NO: 3399530 - protein, 4 aa, Plasmodium falciparum
IKTN

SEQ ID NO: 3399531 - protein, 14 aa, Plasmodium falciparum
IKTSKEGSHEERPR

SEQ ID NO: 3399532 - protein, 38 aa, Plasmodium falciparum
ILNENNKNNILNENNKNNILNENNKNNILNESNKNNIL

SEQ ID NO: 3399533 - protein, 18 aa, Plasmodium falciparum
ILQNGNNNNNNSNNMNSY

SEQ ID NO: 3399534 - protein, 4 aa, Plasmodium falciparum
INDE

SEQ ID NO: 3399535 - protein, 8 aa, Plasmodium falciparum
INDQRRNT

SEQ ID NO: 3399536 - protein, 4 aa, Plasmodium falciparum
INED

SEQ ID NO: 3399537 - protein, 13 aa, Plasmodium falciparum
INEEDSEPFPRQK

SEQ ID NO: 3399538 - protein, 41 aa, Plasmodium falciparum
INEENNSERNDKEKGETKGSNKEGTTPTDNTTEETETKTKT

SEQ ID NO: 3399539 - protein, 33 aa, Plasmodium falciparum
INEEPYEDTHNKEENSSNKNDNDEKRKEENNNI

SEQ ID NO: 3399540 - protein, 8 aa, Plasmodium falciparum
INENSSSI

SEQ ID NO: 3399541 - protein, 16 aa, Plasmodium falciparum
INEQKNDSINNNNEKK

SEQ ID NO: 3399542 - protein, 6 aa, Plasmodium falciparum
INGGEG

SEQ ID NO: 3399543 - protein, 10 aa, Plasmodium falciparum
INKGEEHNVE

SEQ ID NO: 3399544 - protein, 8 aa, Plasmodium falciparum
INKNDLTK

SEQ ID NO: 3399545 - protein, 8 aa, Plasmodium falciparum
INNEDDNY

SEQ ID NO: 3399546 - protein, 4 aa, Plasmodium falciparum
INNG

SEQ ID NO: 3399547 - protein, 12 aa, Plasmodium falciparum
INNGINNGINNG

SEQ ID NO: 3399548 - protein, 25 aa, Plasmodium falciparum
INNKGDMDEENNEDHVNKTKEEHSF

SEQ ID NO: 3399549 - protein, 5 aa, Plasmodium falciparum
INNKS

SEQ ID NO: 3399550 - protein, 6 aa, Plasmodium falciparum
INNNGD

SEQ ID NO: 3399551 - protein, 11 aa, Plasmodium falciparum
INNNNNNNNNM

SEQ ID NO: 3399552 - protein, 10 aa, Plasmodium falciparum
INNPDEKDNT

SEQ ID NO: 3399553 - protein, 4 aa, Plasmodium falciparum
INNR

SEQ ID NO: 3399554 - protein, 6 aa, Plasmodium falciparum
INRENA

SEQ ID NO: 3399555 - protein, 4 aa, Plasmodium falciparum
INSE

SEQ ID NO: 3399556 - protein, 7 aa, Plasmodium falciparum
INSELEK

SEQ ID NO: 3399557 - protein, 11 aa, Plasmodium falciparum
INSELSQDDLK

SEQ ID NO: 3399558 - protein, 8 aa, Plasmodium falciparum
INSNTTNV

SEQ ID NO: 3399559 - protein, 6 aa, Plasmodium falciparum
INSPNY

SEQ ID NO: 3399560 - protein, 12 aa, Plasmodium falciparum
INSSNNESFNEK

SEQ ID NO: 3399561 - protein, 7 aa, Plasmodium falciparum
INTEEER

SEQ ID NO: 3399562 - protein, 25 aa, Plasmodium falciparum
INVGNDDNDDNDDDDDDDDDDDDNV

SEQ ID NO: 3399563 - protein, 6 aa, Plasmodium falciparum
INYNTD

SEQ ID NO: 3399564 - protein, 6 aa, Plasmodium falciparum
IPDINK

SEQ ID NO: 3399565 - protein, 9 aa, Plasmodium falciparum
IPDNKKTSV

SEQ ID NO: 3399566 - protein, 19 aa, Plasmodium falciparum
IPDSIQDSLKESRKLSDRG

SEQ ID NO: 3399567 - protein, 5 aa, Plasmodium falciparum
IPEEE

SEQ ID NO: 3399568 - protein, 14 aa, Plasmodium falciparum
IPEEQQLGEQQEPE

SEQ ID NO: 3399569 - protein, 80 aa, Plasmodium falciparum
IPKIDNDNNNNNNNDNNNNNNNDNNNNNNNDNNNNNNNVDGDDNTTIQNKGPTNISSTNEHKNINTNNQNKQKLHSENHH

SEQ ID NO: 3399570 - protein, 8 aa, Plasmodium falciparum
IPKKTEQD

SEQ ID NO: 3399571 - protein, 8 aa, Plasmodium falciparum
IPNKNELD

SEQ ID NO: 3399572 - protein, 13 aa, Plasmodium falciparum
IPQTEQDSISPST

SEQ ID NO: 3399573 - protein, 5 aa, Plasmodium falciparum
IPSHT

SEQ ID NO: 3399574 - protein, 11 aa, Plasmodium falciparum
IPSRDEYNEAY

SEQ ID NO: 3399575 - protein, 9 aa, Plasmodium falciparum
IQKGKENNK

SEQ ID NO: 3399576 - protein, 7 aa, Plasmodium falciparum
IQNDSEY

SEQ ID NO: 3399577 - protein, 4 aa, Plasmodium falciparum
IQNK

SEQ ID NO: 3399578 - protein, 7 aa, Plasmodium falciparum
IQNKENM

SEQ ID NO: 3399579 - protein, 15 aa, Plasmodium falciparum
IQRDTYENKDYESDD

SEQ ID NO: 3399580 - protein, 24 aa, Plasmodium falciparum
IQSNTTYNSESYESISNNLDESNL

SEQ ID NO: 3399581 - protein, 7 aa, Plasmodium falciparum
IRAEATG

SEQ ID NO: 3399582 - protein, 8 aa, Plasmodium falciparum
IRRGEENI

SEQ ID NO: 3399583 - protein, 5 aa, Plasmodium falciparum
IRTEQ

SEQ ID NO: 3399584 - protein, 12 aa, Plasmodium falciparum
ISDELNESNIKN

SEQ ID NO: 3399585 - protein, 12 aa, Plasmodium falciparum
ISDTDGSPNDFT

SEQ ID NO: 3399586 - protein, 81 aa, Plasmodium falciparum
ISEEEDKQKYAENLDDDDEDDEEDDDDEDDEDNDDDEDDDDDDDEDNDDEDDEDNDDEDDEDNDDEDDEDNDDDDEEDKGV

SEQ ID NO: 3399587 - protein, 6 aa, Plasmodium falciparum
ISEGNV

SEQ ID NO: 3399588 - protein, 8 aa, Plasmodium falciparum
ISENDNEY

SEQ ID NO: 3399589 - protein, 6 aa, Plasmodium falciparum
ISGGDA

SEQ ID NO: 3399590 - protein, 4 aa, Plasmodium falciparum
ISGH

SEQ ID NO: 3399591 - protein, 6 aa, Plasmodium falciparum
ISGSLS

SEQ ID NO: 3399592 - protein, 5 aa, Plasmodium falciparum
ISKDE

SEQ ID NO: 3399593 - protein, 13 aa, Plasmodium falciparum
ISKDKKKDNKEHH

SEQ ID NO: 3399594 - protein, 8 aa, Plasmodium falciparum
ISKPTGNL

SEQ ID NO: 3399595 - protein, 5 aa, Plasmodium falciparum
ISKSN

SEQ ID NO: 3399596 - protein, 19 aa, Plasmodium falciparum
ISLGEEDELSDAEHYNDGS

SEQ ID NO: 3399597 - protein, 6 aa, Plasmodium falciparum
ISLSPK

SEQ ID NO: 3399598 - protein, 4 aa, Plasmodium falciparum
ISND

SEQ ID NO: 3399599 - protein, 5 aa, Plasmodium falciparum
ISNDE

SEQ ID NO: 3399600 - protein, 18 aa, Plasmodium falciparum
ISNNGDNQINNDYDTTYN

SEQ ID NO: 3399601 - protein, 23 aa, Plasmodium falciparum
ISNSNQDINNKNVDHDENNKTKV

SEQ ID NO: 3399602 - protein, 10 aa, Plasmodium falciparum
ISPDKTNEKP

SEQ ID NO: 3399603 - protein, 5 aa, Plasmodium falciparum
ISPRN

SEQ ID NO: 3399604 - protein, 37 aa, Plasmodium falciparum
ISQDISQDISQDMNQSTNTNTNTNTNTKPVKVEEQSE

SEQ ID NO: 3399605 - protein, 12 aa, Plasmodium falciparum
ISRNTHNSPAAI

SEQ ID NO: 3399606 - protein, 4 aa, Plasmodium falciparum
ISRV

SEQ ID NO: 3399607 - protein, 13 aa, Plasmodium falciparum
ISSDDDKEENDAS

SEQ ID NO: 3399608 - protein, 6 aa, Plasmodium falciparum
ISSDTH

SEQ ID NO: 3399609 - protein, 20 aa, Plasmodium falciparum
ISSHNSNQFSTDPHTNSNNI

SEQ ID NO: 3399610 - protein, 9 aa, Plasmodium falciparum
ISSNNDEKK

SEQ ID NO: 3399611 - protein, 7 aa, Plasmodium falciparum
ISSTHDD

SEQ ID NO: 3399612 - protein, 4 aa, Plasmodium falciparum
ISTE

SEQ ID NO: 3399613 - protein, 11 aa, Plasmodium falciparum
ISTNKSNGLPK

SEQ ID NO: 3399614 - protein, 17 aa, Plasmodium falciparum
ITDNDDDSEIRSESEID

SEQ ID NO: 3399615 - protein, 5 aa, Plasmodium falciparum
ITEKN

SEQ ID NO: 3399616 - protein, 5 aa, Plasmodium falciparum
ITESN

SEQ ID NO: 3399617 - protein, 5 aa, Plasmodium falciparum
ITGKT

SEQ ID NO: 3399618 - protein, 10 aa, Plasmodium falciparum
ITGNDGNNKR

SEQ ID NO: 3399619 - protein, 8 aa, Plasmodium falciparum
ITKGRGNY

SEQ ID NO: 3399620 - protein, 25 aa, Plasmodium falciparum
ITKRKKKNKPDISTSSHATDEQQVS

SEQ ID NO: 3399621 - protein, 9 aa, Plasmodium falciparum
ITNDSDHKT

SEQ ID NO: 3399622 - protein, 10 aa, Plasmodium falciparum
ITNSKSKVAN

SEQ ID NO: 3399623 - protein, 13 aa, Plasmodium falciparum
ITNSKSNEYSHRN

SEQ ID NO: 3399624 - protein, 7 aa, Plasmodium falciparum
ITNTNVD

SEQ ID NO: 3399625 - protein, 17 aa, Plasmodium falciparum
ITQNEKSEKNEKNENNM

SEQ ID NO: 3399626 - protein, 13 aa, Plasmodium falciparum
ITQSKQTKSIHSQ

SEQ ID NO: 3399627 - protein, 18 aa, Plasmodium falciparum
ITSEQSNKSIEKNSFEKS

SEQ ID NO: 3399628 - protein, 11 aa, Plasmodium falciparum
ITSQKNNLQSE

SEQ ID NO: 3399629 - protein, 11 aa, Plasmodium falciparum
ITSSNNNEKIT

SEQ ID NO: 3399630 - protein, 7 aa, Plasmodium falciparum
IVESNEK

SEQ ID NO: 3399631 - protein, 5 aa, Plasmodium falciparum
IVNSA

SEQ ID NO: 3399632 - protein, 5 aa, Plasmodium falciparum
IYENG

SEQ ID NO: 3399633 - protein, 5 aa, Plasmodium falciparum
IYTEE

SEQ ID NO: 3399634 - protein, 9 aa, Plasmodium falciparum
KAAEAGDVE

SEQ ID NO: 3399635 - protein, 8 aa, Plasmodium falciparum
KAANAGGV

SEQ ID NO: 3399636 - protein, 11 aa, Plasmodium falciparum
KAANGKKDKNG

SEQ ID NO: 3399637 - protein, 4 aa, Plasmodium falciparum
KADS

SEQ ID NO: 3399638 - protein, 14 aa, Plasmodium falciparum
KAETEDDDEDDYTE

SEQ ID NO: 3399639 - protein, 10 aa, Plasmodium falciparum
KAGDNPQHNS

SEQ ID NO: 3399640 - protein, 6 aa, Plasmodium falciparum
KAGKSS

SEQ ID NO: 3399641 - protein, 15 aa, Plasmodium falciparum
KAGNNIIRDGLDNFK

SEQ ID NO: 3399642 - protein, 41 aa, Plasmodium falciparum
KAKDDAEKSSKADSISTKTKEYAEKAKNAYEKAKNAYQKAN

SEQ ID NO: 3399643 - protein, 5 aa, Plasmodium falciparum
KAKDN

SEQ ID NO: 3399644 - protein, 4 aa, Plasmodium falciparum
KAKE

SEQ ID NO: 3399645 - protein, 29 aa, Plasmodium falciparum
KAKKASEDAEKAANDAENASKEAEEAAKE

SEQ ID NO: 3399646 - protein, 10 aa, Plasmodium falciparum
KAKKKEKTYE

SEQ ID NO: 3399647 - protein, 5 aa, Plasmodium falciparum
KAKYE

SEQ ID NO: 3399648 - protein, 5 aa, Plasmodium falciparum
KAPID

SEQ ID NO: 3399649 - protein, 12 aa, Plasmodium falciparum
KAPQDYKGPCPN

SEQ ID NO: 3399650 - protein, 7 aa, Plasmodium falciparum
KAPSMND

SEQ ID NO: 3399651 - protein, 36 aa, Plasmodium falciparum
KAQSETDTQSKNEQEISTQGQEVQKPAQGGESTFQK

SEQ ID NO: 3399652 - protein, 10 aa, Plasmodium falciparum
KASDSTPKGE

SEQ ID NO: 3399653 - protein, 8 aa, Plasmodium falciparum
KCESGKNQ

SEQ ID NO: 3399654 - protein, 7 aa, Plasmodium falciparum
KCKNGDK

SEQ ID NO: 3399655 - protein, 15 aa, Plasmodium falciparum
KCPKDDITSNINNNN

SEQ ID NO: 3399656 - protein, 6 aa, Plasmodium falciparum
KCSTDK

SEQ ID NO: 3399657 - protein, 7 aa, Plasmodium falciparum
KDAASPG

SEQ ID NO: 3399658 - protein, 8 aa, Plasmodium falciparum
KDCGGENA

SEQ ID NO: 3399659 - protein, 8 aa, Plasmodium falciparum
KDDDVEEK

SEQ ID NO: 3399660 - protein, 5 aa, Plasmodium falciparum
KDDEL

SEQ ID NO: 3399661 - protein, 5 aa, Plasmodium falciparum
KDDHK

SEQ ID NO: 3399662 - protein, 4 aa, Plasmodium falciparum
KDDI

SEQ ID NO: 3399663 - protein, 20 aa, Plasmodium falciparum
KDDKKKSVSFENTPNEEEEK

SEQ ID NO: 3399664 - protein, 5 aa, Plasmodium falciparum
KDDKN

SEQ ID NO: 3399665 - protein, 12 aa, Plasmodium falciparum
KDDTAKDKDLYS

SEQ ID NO: 3399666 - protein, 8 aa, Plasmodium falciparum
KDEEAEKL

SEQ ID NO: 3399667 - protein, 8 aa, Plasmodium falciparum
KDEKPNID

SEQ ID NO: 3399668 - protein, 5 aa, Plasmodium falciparum
KDEKY

SEQ ID NO: 3399669 - protein, 14 aa, Plasmodium falciparum
KDELSDNLENNPVK

SEQ ID NO: 3399670 - protein, 7 aa, Plasmodium falciparum
KDENKNM

SEQ ID NO: 3399671 - protein, 9 aa, Plasmodium falciparum
KDENRNKKN

SEQ ID NO: 3399672 - protein, 7 aa, Plasmodium falciparum
KDEPLEN

SEQ ID NO: 3399673 - protein, 6 aa, Plasmodium falciparum
KDEQRD

SEQ ID NO: 3399674 - protein, 8 aa, Plasmodium falciparum
KDETATIN

SEQ ID NO: 3399675 - protein, 5 aa, Plasmodium falciparum
KDEYD

SEQ ID NO: 3399676 - protein, 12 aa, Plasmodium falciparum
KDGANGKPFDIN

SEQ ID NO: 3399677 - protein, 4 aa, Plasmodium falciparum
KDGF

SEQ ID NO: 3399678 - protein, 13 aa, Plasmodium falciparum
KDGTKRLSKVENG

SEQ ID NO: 3399679 - protein, 4 aa, Plasmodium falciparum
KDGV

SEQ ID NO: 3399680 - protein, 5 aa, Plasmodium falciparum
KDHDR

SEQ ID NO: 3399681 - protein, 10 aa, Plasmodium falciparum
KDHKKKNKIL

SEQ ID NO: 3399682 - protein, 8 aa, Plasmodium falciparum
KDHNNVNS

SEQ ID NO: 3399683 - protein, 4 aa, Plasmodium falciparum
KDHR

SEQ ID NO: 3399684 - protein, 8 aa, Plasmodium falciparum
KDIKENYN

SEQ ID NO: 3399685 - protein, 6 aa, Plasmodium falciparum
KDIKGN

SEQ ID NO: 3399686 - protein, 8 aa, Plasmodium falciparum
KDISKCNA

SEQ ID NO: 3399687 - protein, 6 aa, Plasmodium falciparum
KDKCKE

SEQ ID NO: 3399688 - protein, 8 aa, Plasmodium falciparum
KDKDGKLS

SEQ ID NO: 3399689 - protein, 7 aa, Plasmodium falciparum
KDKDGTQ

SEQ ID NO: 3399690 - protein, 4 aa, Plasmodium falciparum
KDKK

SEQ ID NO: 3399691 - protein, 6 aa, Plasmodium falciparum
KDKKHI

SEQ ID NO: 3399692 - protein, 6 aa, Plasmodium falciparum
KDKNIN

SEQ ID NO: 3399693 - protein, 10 aa, Plasmodium falciparum
KDKPKETKLA

SEQ ID NO: 3399694 - protein, 12 aa, Plasmodium falciparum
KDKQHNIQTDPY

SEQ ID NO: 3399695 - protein, 9 aa, Plasmodium falciparum
KDKSNLKNK

SEQ ID NO: 3399696 - protein, 6 aa, Plasmodium falciparum
KDKVNT

SEQ ID NO: 3399697 - protein, 8 aa, Plasmodium falciparum
KDLEEKSF

SEQ ID NO: 3399698 - protein, 6 aa, Plasmodium falciparum
KDLGAD

SEQ ID NO: 3399699 - protein, 15 aa, Plasmodium falciparum
KDLQQDLNDEPLEPF

SEQ ID NO: 3399700 - protein, 7 aa, Plasmodium falciparum
KDNESGK

SEQ ID NO: 3399701 - protein, 7 aa, Plasmodium falciparum
KDNGKNY

SEQ ID NO: 3399702 - protein, 20 aa, Plasmodium falciparum
KDNIKEADEHEKKEREKETS

SEQ ID NO: 3399703 - protein, 7 aa, Plasmodium falciparum
KDNKTVK

SEQ ID NO: 3399704 - protein, 7 aa, Plasmodium falciparum
KDNKYKE

SEQ ID NO: 3399705 - protein, 4 aa, Plasmodium falciparum
KDNL

SEQ ID NO: 3399706 - protein, 8 aa, Plasmodium falciparum
KDNNEVKN

SEQ ID NO: 3399707 - protein, 35 aa, Plasmodium falciparum
KDNNKKKNNNNINSNNNNINSNNNNNNNNNNNNNI

SEQ ID NO: 3399708 - protein, 8 aa, Plasmodium falciparum
KDNNSSNN

SEQ ID NO: 3399709 - protein, 13 aa, Plasmodium falciparum
KDNQNKPADNMND

SEQ ID NO: 3399710 - protein, 4 aa, Plasmodium falciparum
KDNS

SEQ ID NO: 3399711 - protein, 6 aa, Plasmodium falciparum
KDNSKV

SEQ ID NO: 3399712 - protein, 12 aa, Plasmodium falciparum
KDPEFKKEKRKI

SEQ ID NO: 3399713 - protein, 6 aa, Plasmodium falciparum
KDPFTS

SEQ ID NO: 3399714 - protein, 19 aa, Plasmodium falciparum
KDPNKKNCNKGNKEHKKNV

SEQ ID NO: 3399715 - protein, 6 aa, Plasmodium falciparum
KDPNYQ

SEQ ID NO: 3399716 - protein, 7 aa, Plasmodium falciparum
KDQNEHK

SEQ ID NO: 3399717 - protein, 5 aa, Plasmodium falciparum
KDQNN

SEQ ID NO: 3399718 - protein, 9 aa, Plasmodium falciparum
KDQSKKKKS

SEQ ID NO: 3399719 - protein, 15 aa, Plasmodium falciparum
KDREQKISNEQTSVQ

SEQ ID NO: 3399720 - protein, 7 aa, Plasmodium falciparum
KDSAEEI

SEQ ID NO: 3399721 - protein, 9 aa, Plasmodium falciparum
KDSCREPNH

SEQ ID NO: 3399722 - protein, 8 aa, Plasmodium falciparum
KDSDHNND

SEQ ID NO: 3399723 - protein, 9 aa, Plasmodium falciparum
KDSEEDIYN

SEQ ID NO: 3399724 - protein, 8 aa, Plasmodium falciparum
KDSKDSGK

SEQ ID NO: 3399725 - protein, 9 aa, Plasmodium falciparum
KDSNKDNTF

SEQ ID NO: 3399726 - protein, 4 aa, Plasmodium falciparum
KDSQ

SEQ ID NO: 3399727 - protein, 5 aa, Plasmodium falciparum
KDSYI

SEQ ID NO: 3399728 - protein, 5 aa, Plasmodium falciparum
KDTDY

SEQ ID NO: 3399729 - protein, 5 aa, Plasmodium falciparum
KDTEY

SEQ ID NO: 3399730 - protein, 26 aa, Plasmodium falciparum
KDTKKDVKKHVKNTKEKGKNLTRKAK

SEQ ID NO: 3399731 - protein, 8 aa, Plasmodium falciparum
KDVPEDER

SEQ ID NO: 3399732 - protein, 10 aa, Plasmodium falciparum
KDVSSGSFEY

SEQ ID NO: 3399733 - protein, 6 aa, Plasmodium falciparum
KDYDNF

SEQ ID NO: 3399734 - protein, 14 aa, Plasmodium falciparum
KDYEENKDINKKSN

SEQ ID NO: 3399735 - protein, 8 aa, Plasmodium falciparum
KDYKNSNN

SEQ ID NO: 3399736 - protein, 6 aa, Plasmodium falciparum
KEACEE

SEQ ID NO: 3399737 - protein, 6 aa, Plasmodium falciparum
KEADIT

SEQ ID NO: 3399738 - protein, 7 aa, Plasmodium falciparum
KEAENAR

SEQ ID NO: 3399739 - protein, 8 aa, Plasmodium falciparum
KEDDKKRK

SEQ ID NO: 3399740 - protein, 28 aa, Plasmodium falciparum
KEDDNLNSPSNNMNNIPNGNVNNNDNTI

SEQ ID NO: 3399741 - protein, 8 aa, Plasmodium falciparum
KEDEENEK

SEQ ID NO: 3399742 - protein, 9 aa, Plasmodium falciparum
KEDEPEPWP

SEQ ID NO: 3399743 - protein, 4 aa, Plasmodium falciparum
KEDI

SEQ ID NO: 3399744 - protein, 8 aa, Plasmodium falciparum
KEDNDFND

SEQ ID NO: 3399745 - protein, 13 aa, Plasmodium falciparum
KEDNELKNNEMDT

SEQ ID NO: 3399746 - protein, 10 aa, Plasmodium falciparum
KEDNKNGYDK

SEQ ID NO: 3399747 - protein, 5 aa, Plasmodium falciparum
KEDNL

SEQ ID NO: 3399748 - protein, 20 aa, Plasmodium falciparum
KEDPSSNGGGNTVDQADTSY

SEQ ID NO: 3399749 - protein, 10 aa, Plasmodium falciparum
KEDQEDEEVS

SEQ ID NO: 3399750 - protein, 9 aa, Plasmodium falciparum
KEDSYKNER

SEQ ID NO: 3399751 - protein, 5 aa, Plasmodium falciparum
KEEEV

SEQ ID NO: 3399752 - protein, 7 aa, Plasmodium falciparum
KEEGYNE

SEQ ID NO: 3399753 - protein, 13 aa, Plasmodium falciparum
KEEINNKGKKSLN

SEQ ID NO: 3399754 - protein, 35 aa, Plasmodium falciparum
KEEKDEKDDVPTTSNDNLKNAHNNNEISSSTDPTN

SEQ ID NO: 3399755 - protein, 11 aa, Plasmodium falciparum
KEEKKKKNPHA

SEQ ID NO: 3399756 - protein, 5 aa, Plasmodium falciparum
KEEKT

SEQ ID NO: 3399757 - protein, 16 aa, Plasmodium falciparum
KEELQNVSSSEVRDDN

SEQ ID NO: 3399758 - protein, 9 aa, Plasmodium falciparum
KEEQDASNI

SEQ ID NO: 3399759 - protein, 22 aa, Plasmodium falciparum
KEFSNDEDINKLNDDDTNLRKT

SEQ ID NO: 3399760 - protein, 8 aa, Plasmodium falciparum
KEFTNTKE

SEQ ID NO: 3399761 - protein, 11 aa, Plasmodium falciparum
KEGENKRNNKL

SEQ ID NO: 3399762 - protein, 8 aa, Plasmodium falciparum
KEGGGKAF

SEQ ID NO: 3399763 - protein, 35 aa, Plasmodium falciparum
KEGKKNKETLRSELENETDEEKKKEITKKLSEPST

SEQ ID NO: 3399764 - protein, 9 aa, Plasmodium falciparum
KEGKKSVYY

SEQ ID NO: 3399765 - protein, 7 aa, Plasmodium falciparum
KEGNFDE

SEQ ID NO: 3399766 - protein, 8 aa, Plasmodium falciparum
KEGNKSSP

SEQ ID NO: 3399767 - protein, 13 aa, Plasmodium falciparum
KEIEEKKLEKQKL

SEQ ID NO: 3399768 - protein, 4 aa, Plasmodium falciparum
KEIG

SEQ ID NO: 3399769 - protein, 4 aa, Plasmodium falciparum
KEIK

SEQ ID NO: 3399770 - protein, 22 aa, Plasmodium falciparum
KEINNNNNNNKKKKSYNNNYKN

SEQ ID NO: 3399771 - protein, 8 aa, Plasmodium falciparum
KEIRNKKI

SEQ ID NO: 3399772 - protein, 6 aa, Plasmodium falciparum
KEKAKT

SEQ ID NO: 3399773 - protein, 4 aa, Plasmodium falciparum
KEKD

SEQ ID NO: 3399774 - protein, 7 aa, Plasmodium falciparum
KEKDKNY

SEQ ID NO: 3399775 - protein, 10 aa, Plasmodium falciparum
KEKDNVDNNM

SEQ ID NO: 3399776 - protein, 4 aa, Plasmodium falciparum
KEKE

SEQ ID NO: 3399777 - protein, 14 aa, Plasmodium falciparum
KEKEEEKNKKPYDK

SEQ ID NO: 3399778 - protein, 15 aa, Plasmodium falciparum
KEKEEYEKIKQENKD

SEQ ID NO: 3399779 - protein, 18 aa, Plasmodium falciparum
KEKEKENKLAKKKREISN

SEQ ID NO: 3399780 - protein, 5 aa, Plasmodium falciparum
KEKEN

SEQ ID NO: 3399781 - protein, 7 aa, Plasmodium falciparum
KEKGEEV

SEQ ID NO: 3399782 - protein, 10 aa, Plasmodium falciparum
KEKHTNKAVS

SEQ ID NO: 3399783 - protein, 6 aa, Plasmodium falciparum
KEKKEK

SEQ ID NO: 3399784 - protein, 6 aa, Plasmodium falciparum
KEKKGR

SEQ ID NO: 3399785 - protein, 17 aa, Plasmodium falciparum
KEKKLKEKKKKEEMEEN

SEQ ID NO: 3399786 - protein, 63 aa, Plasmodium falciparum
KEKKNNDNQNYDNPNNDNPNYDNQNYDNQNYNNPNYDHPNYDNQNYDNQNYNNPNNDYSTSQL

SEQ ID NO: 3399787 - protein, 16 aa, Plasmodium falciparum
KEKKNNKTNSDHNNKY

SEQ ID NO: 3399788 - protein, 7 aa, Plasmodium falciparum
KEKKPYV

SEQ ID NO: 3399789 - protein, 4 aa, Plasmodium falciparum
KEKL

SEQ ID NO: 3399790 - protein, 6 aa, Plasmodium falciparum
KEKNEV

SEQ ID NO: 3399791 - protein, 5 aa, Plasmodium falciparum
KEKNI

SEQ ID NO: 3399792 - protein, 11 aa, Plasmodium falciparum
KEKPKYTPPQY

SEQ ID NO: 3399793 - protein, 8 aa, Plasmodium falciparum
KEKPSSEG

SEQ ID NO: 3399794 - protein, 18 aa, Plasmodium falciparum
KEKQLKQEEGQNKNQNVD

SEQ ID NO: 3399795 - protein, 10 aa, Plasmodium falciparum
KEKRKQELEE

SEQ ID NO: 3399796 - protein, 4 aa, Plasmodium falciparum
KELK

SEQ ID NO: 3399797 - protein, 7 aa, Plasmodium falciparum
KELKDED

SEQ ID NO: 3399798 - protein, 18 aa, Plasmodium falciparum
KELSSKKIPYNDCNDEKD

SEQ ID NO: 3399799 - protein, 4 aa, Plasmodium falciparum
KELY

SEQ ID NO: 3399800 - protein, 7 aa, Plasmodium falciparum
KEMKKQK

SEQ ID NO: 3399801 - protein, 7 aa, Plasmodium falciparum
KENAQDN

SEQ ID NO: 3399802 - protein, 7 aa, Plasmodium falciparum
KENDSLQ

SEQ ID NO: 3399803 - protein, 36 aa, Plasmodium falciparum
KENEDTKREVQETEDTDETEDTDETEETEDMEDENE

SEQ ID NO: 3399804 - protein, 5 aa, Plasmodium falciparum
KENEE

SEQ ID NO: 3399805 - protein, 9 aa, Plasmodium falciparum
KENELKGEE

SEQ ID NO: 3399806 - protein, 5 aa, Plasmodium falciparum
KENEQ

SEQ ID NO: 3399807 - protein, 6 aa, Plasmodium falciparum
KENGNN

SEQ ID NO: 3399808 - protein, 5 aa, Plasmodium falciparum
KENHI

SEQ ID NO: 3399809 - protein, 5 aa, Plasmodium falciparum
KENIN

SEQ ID NO: 3399810 - protein, 6 aa, Plasmodium falciparum
KENKND

SEQ ID NO: 3399811 - protein, 10 aa, Plasmodium falciparum
KENKNDIQNV

SEQ ID NO: 3399812 - protein, 5 aa, Plasmodium falciparum
KENNI

SEQ ID NO: 3399813 - protein, 8 aa, Plasmodium falciparum
KENNISDR

SEQ ID NO: 3399814 - protein, 5 aa, Plasmodium falciparum
KENNN

SEQ ID NO: 3399815 - protein, 6 aa, Plasmodium falciparum
KENNSK

SEQ ID NO: 3399816 - protein, 7 aa, Plasmodium falciparum
KENNTSI

SEQ ID NO: 3399817 - protein, 9 aa, Plasmodium falciparum
KENPSCDDK

SEQ ID NO: 3399818 - protein, 5 aa, Plasmodium falciparum
KENRR

SEQ ID NO: 3399819 - protein, 6 aa, Plasmodium falciparum
KENSNI

SEQ ID NO: 3399820 - protein, 11 aa, Plasmodium falciparum
KENTDKSFTED

SEQ ID NO: 3399821 - protein, 7 aa, Plasmodium falciparum
KEPNHIN

SEQ ID NO: 3399822 - protein, 7 aa, Plasmodium falciparum
KEPPCDG

SEQ ID NO: 3399823 - protein, 7 aa, Plasmodium falciparum
KEPSALS

SEQ ID NO: 3399824 - protein, 7 aa, Plasmodium falciparum
KEPTNED

SEQ ID NO: 3399825 - protein, 5 aa, Plasmodium falciparum
KEQID

SEQ ID NO: 3399826 - protein, 11 aa, Plasmodium falciparum
KEQKENDGCGS

SEQ ID NO: 3399827 - protein, 9 aa, Plasmodium falciparum
KEQKKNIPL

SEQ ID NO: 3399828 - protein, 5 aa, Plasmodium falciparum
KEQKN

SEQ ID NO: 3399829 - protein, 10 aa, Plasmodium falciparum
KEQNPDLSQK

SEQ ID NO: 3399830 - protein, 6 aa, Plasmodium falciparum
KERGKA

SEQ ID NO: 3399831 - protein, 11 aa, Plasmodium falciparum
KERKMGKYKTQ

SEQ ID NO: 3399832 - protein, 6 aa, Plasmodium falciparum
KERKTL

SEQ ID NO: 3399833 - protein, 7 aa, Plasmodium falciparum
KERTKIK

SEQ ID NO: 3399834 - protein, 6 aa, Plasmodium falciparum
KERYGN

SEQ ID NO: 3399835 - protein, 8 aa, Plasmodium falciparum
KESECPSD

SEQ ID NO: 3399836 - protein, 6 aa, Plasmodium falciparum
KESGKG

SEQ ID NO: 3399837 - protein, 38 aa, Plasmodium falciparum
KESINKVNTSPNKVTNKKGKTPLNNTKSDEKKKSNGRK

SEQ ID NO: 3399838 - protein, 6 aa, Plasmodium falciparum
KESQKY

SEQ ID NO: 3399839 - protein, 7 aa, Plasmodium falciparum
KESQNKY

SEQ ID NO: 3399840 - protein, 9 aa, Plasmodium falciparum
KESSTTNKG

SEQ ID NO: 3399841 - protein, 5 aa, Plasmodium falciparum
KESSY

SEQ ID NO: 3399842 - protein, 4 aa, Plasmodium falciparum
KETC

SEQ ID NO: 3399843 - protein, 6 aa, Plasmodium falciparum
KETIGE

SEQ ID NO: 3399844 - protein, 7 aa, Plasmodium falciparum
KETNQIN

SEQ ID NO: 3399845 - protein, 5 aa, Plasmodium falciparum
KETPF

SEQ ID NO: 3399846 - protein, 6 aa, Plasmodium falciparum
KETTQL

SEQ ID NO: 3399847 - protein, 8 aa, Plasmodium falciparum
KEVEKHSE

SEQ ID NO: 3399848 - protein, 13 aa, Plasmodium falciparum
KEVTSTNDDPLTP

SEQ ID NO: 3399849 - protein, 16 aa, Plasmodium falciparum
KEYAQNGVNQVKNGTI

SEQ ID NO: 3399850 - protein, 7 aa, Plasmodium falciparum
KEYNSSY

SEQ ID NO: 3399851 - protein, 4 aa, Plasmodium falciparum
KEYR

SEQ ID NO: 3399852 - protein, 19 aa, Plasmodium falciparum
KFADEDKNLREKVEAKNNL

SEQ ID NO: 3399853 - protein, 18 aa, Plasmodium falciparum
KFEKEKSKYEDTKSITAE

SEQ ID NO: 3399854 - protein, 4 aa, Plasmodium falciparum
KFEN

SEQ ID NO: 3399855 - protein, 6 aa, Plasmodium falciparum
KFESVT

SEQ ID NO: 3399856 - protein, 6 aa, Plasmodium falciparum
KFNDEE

SEQ ID NO: 3399857 - protein, 5 aa, Plasmodium falciparum
KFQSI

SEQ ID NO: 3399858 - protein, 6 aa, Plasmodium falciparum
KFRETE

SEQ ID NO: 3399859 - protein, 4 aa, Plasmodium falciparum
KFSD

SEQ ID NO: 3399860 - protein, 12 aa, Plasmodium falciparum
KGATSSKKNQYG

SEQ ID NO: 3399861 - protein, 4 aa, Plasmodium falciparum
KGDE

SEQ ID NO: 3399862 - protein, 119 aa, Plasmodium falciparum
KGDELDEYKDNKIDDEKNDNKSNDKRNDEKNDNKTNDKRNDEKNDNKTNDKRNDEKNDNKTNDKMKDEKNDNKTNDKMKDEKNDNKTNDKMKDEKNNNERNDKMKDEKNDNKTKDKIND

SEQ ID NO: 3399863 - protein, 12 aa, Plasmodium falciparum
KGDVESQPDVDG

SEQ ID NO: 3399864 - protein, 6 aa, Plasmodium falciparum
KGDVSY

SEQ ID NO: 3399865 - protein, 11 aa, Plasmodium falciparum
KGEDDADSDEY

SEQ ID NO: 3399866 - protein, 6 aa, Plasmodium falciparum
KGEDND

SEQ ID NO: 3399867 - protein, 7 aa, Plasmodium falciparum
KGEEDET

SEQ ID NO: 3399868 - protein, 14 aa, Plasmodium falciparum
KGEHKDRCDEGSSP

SEQ ID NO: 3399869 - protein, 6 aa, Plasmodium falciparum
KGEHKM

SEQ ID NO: 3399870 - protein, 118 aa, Plasmodium falciparum
KGEIKGDENGQVKCDENGQVKCDENGQVKCDENGQVKCDENGQVKCDENGQVKCDENGQVKCDENGQVKCDENGQVKCDENGQVKCDENGQVKCDENGQVKCDENGQVKCDKNKGEIK

SEQ ID NO: 3399871 - protein, 6 aa, Plasmodium falciparum
KGGEGC

SEQ ID NO: 3399872 - protein, 9 aa, Plasmodium falciparum
KGGVGKSTV

SEQ ID NO: 3399873 - protein, 10 aa, Plasmodium falciparum
KGHVPPTTKR

SEQ ID NO: 3399874 - protein, 6 aa, Plasmodium falciparum
KGIEQV

SEQ ID NO: 3399875 - protein, 6 aa, Plasmodium falciparum
KGIQSQ

SEQ ID NO: 3399876 - protein, 6 aa, Plasmodium falciparum
KGKANR

SEQ ID NO: 3399877 - protein, 19 aa, Plasmodium falciparum
KGKEQNHQKLKSQENSAPD

SEQ ID NO: 3399878 - protein, 6 aa, Plasmodium falciparum
KGKHNA

SEQ ID NO: 3399879 - protein, 16 aa, Plasmodium falciparum
KGKISKRCTEGGNPSE

SEQ ID NO: 3399880 - protein, 7 aa, Plasmodium falciparum
KGKPDLR

SEQ ID NO: 3399881 - protein, 9 aa, Plasmodium falciparum
KGKQEIGYE

SEQ ID NO: 3399882 - protein, 6 aa, Plasmodium falciparum
KGLNNS

SEQ ID NO: 3399883 - protein, 19 aa, Plasmodium falciparum
KGNEQDKNNNNNNNNKFTQ

SEQ ID NO: 3399884 - protein, 4 aa, Plasmodium falciparum
KGNI

SEQ ID NO: 3399885 - protein, 9 aa, Plasmodium falciparum
KGNKSNEII

SEQ ID NO: 3399886 - protein, 6 aa, Plasmodium falciparum
KGNLSN

SEQ ID NO: 3399887 - protein, 5 aa, Plasmodium falciparum
KGNRD

SEQ ID NO: 3399888 - protein, 8 aa, Plasmodium falciparum
KGNSHDNY

SEQ ID NO: 3399889 - protein, 6 aa, Plasmodium falciparum
KGNVNP

SEQ ID NO: 3399890 - protein, 6 aa, Plasmodium falciparum
KGNYGE

SEQ ID NO: 3399891 - protein, 87 aa, Plasmodium falciparum
KGRKRKRRRNKRTRRNRTQARKNKNKRKKKKKNEKLAKRRRRRERNRKKKQLKKEKRRRKKNEKKQKKEMKRKEKEERKRRKEEEKL

SEQ ID NO: 3399892 - protein, 10 aa, Plasmodium falciparum
KGSGTGSKKN

SEQ ID NO: 3399893 - protein, 6 aa, Plasmodium falciparum
KGSKTL

SEQ ID NO: 3399894 - protein, 17 aa, Plasmodium falciparum
KGSSKEICESGKRDYNV

SEQ ID NO: 3399895 - protein, 14 aa, Plasmodium falciparum
KGSTEYEESVESEL

SEQ ID NO: 3399896 - protein, 6 aa, Plasmodium falciparum
KGTEKL

SEQ ID NO: 3399897 - protein, 7 aa, Plasmodium falciparum
KGTNKNT

SEQ ID NO: 3399898 - protein, 8 aa, Plasmodium falciparum
KGTTTDST

SEQ ID NO: 3399899 - protein, 8 aa, Plasmodium falciparum
KGVDRPRY

SEQ ID NO: 3399900 - protein, 4 aa, Plasmodium falciparum
KGVK

SEQ ID NO: 3399901 - protein, 9 aa, Plasmodium falciparum
KGYERKSEE

SEQ ID NO: 3399902 - protein, 10 aa, Plasmodium falciparum
KGYRSKLDPN

SEQ ID NO: 3399903 - protein, 8 aa, Plasmodium falciparum
KGYTNTYE

SEQ ID NO: 3399904 - protein, 7 aa, Plasmodium falciparum
KHDNNRQ

SEQ ID NO: 3399905 - protein, 45 aa, Plasmodium falciparum
KHKDNDSRYTDNSNKNRDNSNKNRDNYNRNKDKNNTNRDNYNRYK

SEQ ID NO: 3399906 - protein, 8 aa, Plasmodium falciparum
KHKKQKIN

SEQ ID NO: 3399907 - protein, 6 aa, Plasmodium falciparum
KHKNEI

SEQ ID NO: 3399908 - protein, 14 aa, Plasmodium falciparum
KHKNNDSDDDHDHH

SEQ ID NO: 3399909 - protein, 35 aa, Plasmodium falciparum
KHKTETETETKTETETKTKAKKKKKKKKEKKDESY

SEQ ID NO: 3399910 - protein, 7 aa, Plasmodium falciparum
KHNANSE

SEQ ID NO: 3399911 - protein, 12 aa, Plasmodium falciparum
KHNLHNEQNKFN

SEQ ID NO: 3399912 - protein, 4 aa, Plasmodium falciparum
KHNV

SEQ ID NO: 3399913 - protein, 130 aa, Plasmodium falciparum
KHVDKEEDKKEESKEVEEESKEVQEDEEEVEEDEEEEEEEEEEEEEEEEEEEEEEDEVEEDEDDAEEDEDDAEEDEDDAEEDDDDAEEDDDDAEEDDDEDEDEDEEEEEDEEEEEESEKKIKRNLRKNAK

SEQ ID NO: 3399914 - protein, 6 aa, Plasmodium falciparum
KIADDL

SEQ ID NO: 3399915 - protein, 12 aa, Plasmodium falciparum
KIASEQKNMQNK

SEQ ID NO: 3399916 - protein, 19 aa, Plasmodium falciparum
KIEEEKKKNENDYSNGKDI

SEQ ID NO: 3399917 - protein, 13 aa, Plasmodium falciparum
KIEKDDQKKKQEL

SEQ ID NO: 3399918 - protein, 11 aa, Plasmodium falciparum
KIENKKNKNKK

SEQ ID NO: 3399919 - protein, 29 aa, Plasmodium falciparum
KIKDKNNNNNNNNNSKFSKDGDNEDFNNK

SEQ ID NO: 3399920 - protein, 10 aa, Plasmodium falciparum
KIKDTDDARD

SEQ ID NO: 3399921 - protein, 9 aa, Plasmodium falciparum
KIKEENKNE

SEQ ID NO: 3399922 - protein, 10 aa, Plasmodium falciparum
KIKKPKRKKM

SEQ ID NO: 3399923 - protein, 16 aa, Plasmodium falciparum
KIKNDDANNNNNDNNH

SEQ ID NO: 3399924 - protein, 8 aa, Plasmodium falciparum
KIKPEEEY

SEQ ID NO: 3399925 - protein, 6 aa, Plasmodium falciparum
KIKPNL

SEQ ID NO: 3399926 - protein, 7 aa, Plasmodium falciparum
KILEGEG

SEQ ID NO: 3399927 - protein, 4 aa, Plasmodium falciparum
KIND

SEQ ID NO: 3399928 - protein, 5 aa, Plasmodium falciparum
KINDQ

SEQ ID NO: 3399929 - protein, 8 aa, Plasmodium falciparum
KINNEDPN

SEQ ID NO: 3399930 - protein, 4 aa, Plasmodium falciparum
KINP

SEQ ID NO: 3399931 - protein, 10 aa, Plasmodium falciparum
KINQNGESTI

SEQ ID NO: 3399932 - protein, 11 aa, Plasmodium falciparum
KINYGGGRTAQ

SEQ ID NO: 3399933 - protein, 11 aa, Plasmodium falciparum
KIPLPYEGERS

SEQ ID NO: 3399934 - protein, 5 aa, Plasmodium falciparum
KIQRE

SEQ ID NO: 3399935 - protein, 24 aa, Plasmodium falciparum
KISDANEKKNKTQSTSEGNDYTDN

SEQ ID NO: 3399936 - protein, 4 aa, Plasmodium falciparum
KISG

SEQ ID NO: 3399937 - protein, 6 aa, Plasmodium falciparum
KISSNN

SEQ ID NO: 3399938 - protein, 10 aa, Plasmodium falciparum
KITGSPPGYV

SEQ ID NO: 3399939 - protein, 19 aa, Plasmodium falciparum
KITQEDKEKNIEPNKLESH

SEQ ID NO: 3399940 - protein, 7 aa, Plasmodium falciparum
KKAEENY

SEQ ID NO: 3399941 - protein, 9 aa, Plasmodium falciparum
KKAQKRDNK

SEQ ID NO: 3399942 - protein, 6 aa, Plasmodium falciparum
KKCSEN

SEQ ID NO: 3399943 - protein, 7 aa, Plasmodium falciparum
KKCTKSK

SEQ ID NO: 3399944 - protein, 6 aa, Plasmodium falciparum
KKDEEL

SEQ ID NO: 3399945 - protein, 9 aa, Plasmodium falciparum
KKDHSCSRT

SEQ ID NO: 3399946 - protein, 8 aa, Plasmodium falciparum
KKDKDDIE

SEQ ID NO: 3399947 - protein, 7 aa, Plasmodium falciparum
KKDKGIL

SEQ ID NO: 3399948 - protein, 9 aa, Plasmodium falciparum
KKDKKQLQY

SEQ ID NO: 3399949 - protein, 6 aa, Plasmodium falciparum
KKDLNE

SEQ ID NO: 3399950 - protein, 13 aa, Plasmodium falciparum
KKDNDKKHIKQDN

SEQ ID NO: 3399951 - protein, 4 aa, Plasmodium falciparum
KKDP

SEQ ID NO: 3399952 - protein, 7 aa, Plasmodium falciparum
KKDPTHA

SEQ ID NO: 3399953 - protein, 6 aa, Plasmodium falciparum
KKDSDQ

SEQ ID NO: 3399954 - protein, 6 aa, Plasmodium falciparum
KKEANE

SEQ ID NO: 3399955 - protein, 11 aa, Plasmodium falciparum
KKEDKRDQKKD

SEQ ID NO: 3399956 - protein, 9 aa, Plasmodium falciparum
KKEDNIDKK

SEQ ID NO: 3399957 - protein, 6 aa, Plasmodium falciparum
KKEDNK

SEQ ID NO: 3399958 - protein, 4 aa, Plasmodium falciparum
KKEE

SEQ ID NO: 3399959 - protein, 6 aa, Plasmodium falciparum
KKEEDL

SEQ ID NO: 3399960 - protein, 6 aa, Plasmodium falciparum
KKEEKI

SEQ ID NO: 3399961 - protein, 9 aa, Plasmodium falciparum
KKEEKNNGK

SEQ ID NO: 3399962 - protein, 12 aa, Plasmodium falciparum
KKEEKSSSEPPF

SEQ ID NO: 3399963 - protein, 6 aa, Plasmodium falciparum
KKEELD

SEQ ID NO: 3399964 - protein, 9 aa, Plasmodium falciparum
KKEELGGNP

SEQ ID NO: 3399965 - protein, 11 aa, Plasmodium falciparum
KKEGFVNSPDE

SEQ ID NO: 3399966 - protein, 6 aa, Plasmodium falciparum
KKEGQV

SEQ ID NO: 3399967 - protein, 4 aa, Plasmodium falciparum
KKEH

SEQ ID NO: 3399968 - protein, 7 aa, Plasmodium falciparum
KKEKDNA

SEQ ID NO: 3399969 - protein, 7 aa, Plasmodium falciparum
KKEKESE

SEQ ID NO: 3399970 - protein, 8 aa, Plasmodium falciparum
KKEKNDEL

SEQ ID NO: 3399971 - protein, 8 aa, Plasmodium falciparum
KKELKPAD

SEQ ID NO: 3399972 - protein, 4 aa, Plasmodium falciparum
KKEN

SEQ ID NO: 3399973 - protein, 6 aa, Plasmodium falciparum
KKENEI

SEQ ID NO: 3399974 - protein, 10 aa, Plasmodium falciparum
KKENENNKNN

SEQ ID NO: 3399975 - protein, 6 aa, Plasmodium falciparum
KKENIK

SEQ ID NO: 3399976 - protein, 18 aa, Plasmodium falciparum
KKEPSYVNENKSLEDNHI

SEQ ID NO: 3399977 - protein, 5 aa, Plasmodium falciparum
KKERD

SEQ ID NO: 3399978 - protein, 13 aa, Plasmodium falciparum
KKESNDEKNNKKE

SEQ ID NO: 3399979 - protein, 9 aa, Plasmodium falciparum
KKESNIGKE

SEQ ID NO: 3399980 - protein, 8 aa, Plasmodium falciparum
KKESTPVS

SEQ ID NO: 3399981 - protein, 22 aa, Plasmodium falciparum
KKETITEAKKEVKEVEKFFGIN

SEQ ID NO: 3399982 - protein, 7 aa, Plasmodium falciparum
KKFDDDI

SEQ ID NO: 3399983 - protein, 17 aa, Plasmodium falciparum
KKFPKYSKKPVSPSSNL

SEQ ID NO: 3399984 - protein, 76 aa, Plasmodium falciparum
KKGINEEESDDEKKYEGLRKDSNNKKNNKNNKDNKNNKGNKNNKDNEKNHHHHNNNNSINNKKNKTEREGEGGKNA

SEQ ID NO: 3399985 - protein, 10 aa, Plasmodium falciparum
KKGKDEYEEK

SEQ ID NO: 3399986 - protein, 8 aa, Plasmodium falciparum
KKGKEDEY

SEQ ID NO: 3399987 - protein, 7 aa, Plasmodium falciparum
KKGKKDL

SEQ ID NO: 3399988 - protein, 22 aa, Plasmodium falciparum
KKGKKNKNNNNNNNNSIPDECP

SEQ ID NO: 3399989 - protein, 5 aa, Plasmodium falciparum
KKGLP

SEQ ID NO: 3399990 - protein, 7 aa, Plasmodium falciparum
KKGNGDF

SEQ ID NO: 3399991 - protein, 17 aa, Plasmodium falciparum
KKGRRKYNNNYNKKTLN

SEQ ID NO: 3399992 - protein, 117 aa, Plasmodium falciparum
KKGTKNGINKVKKGAKNGINKVKKGTKSGINKVKEGAKNGINKVKKGTKNGINKVKEGAKNGINKVKKGTKNGINKVKEGTKDGINKVKEGTKNGINKVKEGTKNGINKVKDGAENG

SEQ ID NO: 3399993 - protein, 4 aa, Plasmodium falciparum
KKHA

SEQ ID NO: 3399994 - protein, 6 aa, Plasmodium falciparum
KKHDSV

SEQ ID NO: 3399995 - protein, 21 aa, Plasmodium falciparum
KKHTARDGEYGEYGEAVEDGE

SEQ ID NO: 3399996 - protein, 21 aa, Plasmodium falciparum
KKIETKYDEKEEVEEEGNNKD

SEQ ID NO: 3399997 - protein, 4 aa, Plasmodium falciparum
KKIK

SEQ ID NO: 3399998 - protein, 9 aa, Plasmodium falciparum
KKIKTEGKK

SEQ ID NO: 3399999 - protein, 7 aa, Plasmodium falciparum
KKKCTTI

SEQ ID NO: 3400000 - protein, 8 aa, Plasmodium falciparum
KKKDNNEY

SEQ ID NO: 3400001 - protein, 8 aa, Plasmodium falciparum
KKKEEEKK

SEQ ID NO: 3400002 - protein, 9 aa, Plasmodium falciparum
KKKEKHNCK

SEQ ID NO: 3400003 - protein, 9 aa, Plasmodium falciparum
KKKEKKNIN

SEQ ID NO: 3400004 - protein, 8 aa, Plasmodium falciparum
KKKENKEA

SEQ ID NO: 3400005 - protein, 7 aa, Plasmodium falciparum
KKKENME

SEQ ID NO: 3400006 - protein, 9 aa, Plasmodium falciparum
KKKGEKLEK

SEQ ID NO: 3400007 - protein, 7 aa, Plasmodium falciparum
KKKGIHN

SEQ ID NO: 3400008 - protein, 7 aa, Plasmodium falciparum
KKKGKIR

SEQ ID NO: 3400009 - protein, 4 aa, Plasmodium falciparum
KKKI

SEQ ID NO: 3400010 - protein, 12 aa, Plasmodium falciparum
KKKINQKKKIKN

SEQ ID NO: 3400011 - protein, 9 aa, Plasmodium falciparum
KKKISNEKN

SEQ ID NO: 3400012 - protein, 11 aa, Plasmodium falciparum
KKKKEKKKFCT

SEQ ID NO: 3400013 - protein, 6 aa, Plasmodium falciparum
KKKKIE

SEQ ID NO: 3400014 - protein, 42 aa, Plasmodium falciparum
KKKKIKSNSNNNNSNNNSNNNNSNNNNSNNNNNNSSSIKREC

SEQ ID NO: 3400015 - protein, 7 aa, Plasmodium falciparum
KKKKNEF

SEQ ID NO: 3400016 - protein, 7 aa, Plasmodium falciparum
KKKKNPK

SEQ ID NO: 3400017 - protein, 7 aa, Plasmodium falciparum
KKKKNQN

SEQ ID NO: 3400018 - protein, 26 aa, Plasmodium falciparum
KKKKRRKKKIEMKDNNNNNNSINNNN

SEQ ID NO: 3400019 - protein, 10 aa, Plasmodium falciparum
KKKLKDENIN

SEQ ID NO: 3400020 - protein, 6 aa, Plasmodium falciparum
KKKNAY

SEQ ID NO: 3400021 - protein, 7 aa, Plasmodium falciparum
KKKNHEK

SEQ ID NO: 3400022 - protein, 7 aa, Plasmodium falciparum
KKKNHVR

SEQ ID NO: 3400023 - protein, 13 aa, Plasmodium falciparum
KKKNKTKQGKKNM

SEQ ID NO: 3400024 - protein, 13 aa, Plasmodium falciparum
KKKNLPPIGRRSN

SEQ ID NO: 3400025 - protein, 10 aa, Plasmodium falciparum
KKKNNNKSPL

SEQ ID NO: 3400026 - protein, 7 aa, Plasmodium falciparum
KKKNQGS

SEQ ID NO: 3400027 - protein, 10 aa, Plasmodium falciparum
KKKNSKQKNV

SEQ ID NO: 3400028 - protein, 40 aa, Plasmodium falciparum
KKKNTSIDNENEDNKNNTSNYVSNNTLKDDVSNENENMSD

SEQ ID NO: 3400029 - protein, 13 aa, Plasmodium falciparum
KKKPADTDANPES

SEQ ID NO: 3400030 - protein, 49 aa, Plasmodium falciparum
KKKPKKKGKEKNSANDNNNNNNNDNNNDNYNDNYNNDNNINSNNNYGDM

SEQ ID NO: 3400031 - protein, 6 aa, Plasmodium falciparum
KKKPNY

SEQ ID NO: 3400032 - protein, 7 aa, Plasmodium falciparum
KKKQGKN

SEQ ID NO: 3400033 - protein, 11 aa, Plasmodium falciparum
KKKQKKKGFNK

SEQ ID NO: 3400034 - protein, 5 aa, Plasmodium falciparum
KKKSD

SEQ ID NO: 3400035 - protein, 7 aa, Plasmodium falciparum
KKKSNPL

SEQ ID NO: 3400036 - protein, 11 aa, Plasmodium falciparum
KKKSSHRRTRR

SEQ ID NO: 3400037 - protein, 6 aa, Plasmodium falciparum
KKKSSV

SEQ ID NO: 3400038 - protein, 6 aa, Plasmodium falciparum
KKKVDN

SEQ ID NO: 3400039 - protein, 6 aa, Plasmodium falciparum
KKKVLQ

SEQ ID NO: 3400040 - protein, 13 aa, Plasmodium falciparum
KKKYESGQCHEKD

SEQ ID NO: 3400041 - protein, 6 aa, Plasmodium falciparum
KKLDEY

SEQ ID NO: 3400042 - protein, 7 aa, Plasmodium falciparum
KKLNPQT

SEQ ID NO: 3400043 - protein, 5 aa, Plasmodium falciparum
KKLSD

SEQ ID NO: 3400044 - protein, 8 aa, Plasmodium falciparum
KKLTKNEE

SEQ ID NO: 3400045 - protein, 4 aa, Plasmodium falciparum
KKMD

SEQ ID NO: 3400046 - protein, 7 aa, Plasmodium falciparum
KKMKEKS

SEQ ID NO: 3400047 - protein, 15 aa, Plasmodium falciparum
KKNDENNNRKRKEME

SEQ ID NO: 3400048 - protein, 7 aa, Plasmodium falciparum
KKNDINN

SEQ ID NO: 3400049 - protein, 18 aa, Plasmodium falciparum
KKNDKEQNKSHKNLKENN

SEQ ID NO: 3400050 - protein, 9 aa, Plasmodium falciparum
KKNDKNIEY

SEQ ID NO: 3400051 - protein, 9 aa, Plasmodium falciparum
KKNDNNNHY

SEQ ID NO: 3400052 - protein, 8 aa, Plasmodium falciparum
KKNEDYNI

SEQ ID NO: 3400053 - protein, 6 aa, Plasmodium falciparum
KKNEHD

SEQ ID NO: 3400054 - protein, 6 aa, Plasmodium falciparum
KKNEIS

SEQ ID NO: 3400055 - protein, 15 aa, Plasmodium falciparum
KKNEKAKKEKEKMNQ

SEQ ID NO: 3400056 - protein, 7 aa, Plasmodium falciparum
KKNEKKN

SEQ ID NO: 3400057 - protein, 15 aa, Plasmodium falciparum
KKNENDINQSKQEEQ

SEQ ID NO: 3400058 - protein, 13 aa, Plasmodium falciparum
KKNENQNDKHQDE

SEQ ID NO: 3400059 - protein, 8 aa, Plasmodium falciparum
KKNERKEN

SEQ ID NO: 3400060 - protein, 6 aa, Plasmodium falciparum
KKNGKK

SEQ ID NO: 3400061 - protein, 12 aa, Plasmodium falciparum
KKNGKSKSNNHN

SEQ ID NO: 3400062 - protein, 6 aa, Plasmodium falciparum
KKNGTS

SEQ ID NO: 3400063 - protein, 5 aa, Plasmodium falciparum
KKNGV

SEQ ID NO: 3400064 - protein, 5 aa, Plasmodium falciparum
KKNIT

SEQ ID NO: 3400065 - protein, 5 aa, Plasmodium falciparum
KKNKH

SEQ ID NO: 3400066 - protein, 16 aa, Plasmodium falciparum
KKNKQSSSTNDNQEGV

SEQ ID NO: 3400067 - protein, 6 aa, Plasmodium falciparum
KKNKSC

SEQ ID NO: 3400068 - protein, 4 aa, Plasmodium falciparum
KKNL

SEQ ID NO: 3400069 - protein, 10 aa, Plasmodium falciparum
KKNNAYSHSY

SEQ ID NO: 3400070 - protein, 10 aa, Plasmodium falciparum
KKNNDDNKKK

SEQ ID NO: 3400071 - protein, 8 aa, Plasmodium falciparum
KKNNDEEY

SEQ ID NO: 3400072 - protein, 12 aa, Plasmodium falciparum
KKNNEENKQNVT

SEQ ID NO: 3400073 - protein, 7 aa, Plasmodium falciparum
KKNNTKE

SEQ ID NO: 3400074 - protein, 7 aa, Plasmodium falciparum
KKNPEVY

SEQ ID NO: 3400075 - protein, 9 aa, Plasmodium falciparum
KKNPKNSYN

SEQ ID NO: 3400076 - protein, 9 aa, Plasmodium falciparum
KKNPNDHKK

SEQ ID NO: 3400077 - protein, 6 aa, Plasmodium falciparum
KKNPQI

SEQ ID NO: 3400078 - protein, 20 aa, Plasmodium falciparum
KKNQEKEKSLKGESEDNTKL

SEQ ID NO: 3400079 - protein, 8 aa, Plasmodium falciparum
KKNRKDKA

SEQ ID NO: 3400080 - protein, 7 aa, Plasmodium falciparum
KKNSLGN

SEQ ID NO: 3400081 - protein, 9 aa, Plasmodium falciparum
KKNTNPCET

SEQ ID NO: 3400082 - protein, 6 aa, Plasmodium falciparum
KKNTSY

SEQ ID NO: 3400083 - protein, 6 aa, Plasmodium falciparum
KKPFDK

SEQ ID NO: 3400084 - protein, 17 aa, Plasmodium falciparum
KKPGKENKKLKENVPKD

SEQ ID NO: 3400085 - protein, 22 aa, Plasmodium falciparum
KKPKEKNSSKPKNSKMRKKGQN

SEQ ID NO: 3400086 - protein, 7 aa, Plasmodium falciparum
KKPNRKK

SEQ ID NO: 3400087 - protein, 7 aa, Plasmodium falciparum
KKPSSSI

SEQ ID NO: 3400088 - protein, 80 aa, Plasmodium falciparum
KKPVEKKEDKKNTDNQNENTSKQDAGADKNHNTTENQNEQSAQNQNNENNDDNQNNEHDANQSSNDEQNKNDGASDQKDE

SEQ ID NO: 3400089 - protein, 7 aa, Plasmodium falciparum
KKQKYDY

SEQ ID NO: 3400090 - protein, 7 aa, Plasmodium falciparum
KKQNENI

SEQ ID NO: 3400091 - protein, 5 aa, Plasmodium falciparum
KKQTN

SEQ ID NO: 3400092 - protein, 7 aa, Plasmodium falciparum
KKRDHRN

SEQ ID NO: 3400093 - protein, 17 aa, Plasmodium falciparum
KKRKKKKLKYEHENDYQ

SEQ ID NO: 3400094 - protein, 10 aa, Plasmodium falciparum
KKRKKTNNEK

SEQ ID NO: 3400095 - protein, 11 aa, Plasmodium falciparum
KKRNPDGGKPF

SEQ ID NO: 3400096 - protein, 8 aa, Plasmodium falciparum
KKRPERKL

SEQ ID NO: 3400097 - protein, 9 aa, Plasmodium falciparum
KKRSPNNKN

SEQ ID NO: 3400098 - protein, 22 aa, Plasmodium falciparum
KKSDFNPSDYYTNKKDVNRNDD

SEQ ID NO: 3400099 - protein, 5 aa, Plasmodium falciparum
KKSDH

SEQ ID NO: 3400100 - protein, 8 aa, Plasmodium falciparum
KKSDNDKI

SEQ ID NO: 3400101 - protein, 17 aa, Plasmodium falciparum
KKSEESKDKEINEKKIE

SEQ ID NO: 3400102 - protein, 11 aa, Plasmodium falciparum
KKSELNENNDM

SEQ ID NO: 3400103 - protein, 7 aa, Plasmodium falciparum
KKSFQSF

SEQ ID NO: 3400104 - protein, 5 aa, Plasmodium falciparum
KKSKK

SEQ ID NO: 3400105 - protein, 25 aa, Plasmodium falciparum
KKSLNAEPYDDFSNKKKKKGTKKDK

SEQ ID NO: 3400106 - protein, 7 aa, Plasmodium falciparum
KKSNELE

SEQ ID NO: 3400107 - protein, 8 aa, Plasmodium falciparum
KKSNMESV

SEQ ID NO: 3400108 - protein, 18 aa, Plasmodium falciparum
KKSNNDRMTPVKDPTNGN

SEQ ID NO: 3400109 - protein, 8 aa, Plasmodium falciparum
KKSNYKDS

SEQ ID NO: 3400110 - protein, 6 aa, Plasmodium falciparum
KKSSLY

SEQ ID NO: 3400111 - protein, 4 aa, Plasmodium falciparum
KKST

SEQ ID NO: 3400112 - protein, 6 aa, Plasmodium falciparum
KKSYED

SEQ ID NO: 3400113 - protein, 6 aa, Plasmodium falciparum
KKTKIH

SEQ ID NO: 3400114 - protein, 9 aa, Plasmodium falciparum
KKTKNQENN

SEQ ID NO: 3400115 - protein, 7 aa, Plasmodium falciparum
KKTNNAI

SEQ ID NO: 3400116 - protein, 11 aa, Plasmodium falciparum
KKTRYDKRDTD

SEQ ID NO: 3400117 - protein, 6 aa, Plasmodium falciparum
KKTSPF

SEQ ID NO: 3400118 - protein, 19 aa, Plasmodium falciparum
KKTYDEELKESKEKANDLN

SEQ ID NO: 3400119 - protein, 6 aa, Plasmodium falciparum
KKTYIN

SEQ ID NO: 3400120 - protein, 10 aa, Plasmodium falciparum
KKVDNHNEEK

SEQ ID NO: 3400121 - protein, 11 aa, Plasmodium falciparum
KKVEYDEKTPL

SEQ ID NO: 3400122 - protein, 6 aa, Plasmodium falciparum
KKVQEE

SEQ ID NO: 3400123 - protein, 7 aa, Plasmodium falciparum
KKVSDEN

SEQ ID NO: 3400124 - protein, 140 aa, Plasmodium falciparum
KKYEDKLKGSSTDSKSSVKSGGKKEEKENKKNDIGENKVKSEVKNEVKNEVKSEVKNEVKSEVKNEVKNEVKSEVKSEVKNEVKNEVKSEVKSEVKSEVKSEVKSEVKNEVKSEVKSEEKNEKKAKERLTKSKISKPEQR

SEQ ID NO: 3400125 - protein, 112 aa, Plasmodium falciparum
KKYEEKLSGNSTGSMNNGKSGSKSDIKGGSKDDIKSGSKDDIKSGSKADIKSGSKDDIKSGSKDDIKSGSKADIKSGSKDDIKGGSEEEIKNGKKYENNEEKKRVPGRQSDY

SEQ ID NO: 3400126 - protein, 45 aa, Plasmodium falciparum
KKYEEKLSGSSTGSMNNGERCEKKDDIKNGSDNENKRISKSQLNG

SEQ ID NO: 3400127 - protein, 18 aa, Plasmodium falciparum
KKYHPDKAKDKNSNNKFS

SEQ ID NO: 3400128 - protein, 13 aa, Plasmodium falciparum
KKYKKEKNKKREY

SEQ ID NO: 3400129 - protein, 11 aa, Plasmodium falciparum
KKYNVKSPLGP

SEQ ID NO: 3400130 - protein, 6 aa, Plasmodium falciparum
KKYRDV

SEQ ID NO: 3400131 - protein, 6 aa, Plasmodium falciparum
KKYTSN

SEQ ID NO: 3400132 - protein, 4 aa, Plasmodium falciparum
KKYY

SEQ ID NO: 3400133 - protein, 7 aa, Plasmodium falciparum
KLDGTNN

SEQ ID NO: 3400134 - protein, 5 aa, Plasmodium falciparum
KLEDW

SEQ ID NO: 3400135 - protein, 5 aa, Plasmodium falciparum
KLETT

SEQ ID NO: 3400136 - protein, 4 aa, Plasmodium falciparum
KLGK

SEQ ID NO: 3400137 - protein, 4 aa, Plasmodium falciparum
KLGL

SEQ ID NO: 3400138 - protein, 13 aa, Plasmodium falciparum
KLKDTNEKKELNN

SEQ ID NO: 3400139 - protein, 6 aa, Plasmodium falciparum
KLKTKE

SEQ ID NO: 3400140 - protein, 7 aa, Plasmodium falciparum
KLLPKQK

SEQ ID NO: 3400141 - protein, 6 aa, Plasmodium falciparum
KLNDDQ

SEQ ID NO: 3400142 - protein, 10 aa, Plasmodium falciparum
KLNEERMKNK

SEQ ID NO: 3400143 - protein, 9 aa, Plasmodium falciparum
KLNSDNNIK

SEQ ID NO: 3400144 - protein, 11 aa, Plasmodium falciparum
KLSDEEAKAAR

SEQ ID NO: 3400145 - protein, 6 aa, Plasmodium falciparum
KLSKET

SEQ ID NO: 3400146 - protein, 6 aa, Plasmodium falciparum
KLSKGE

SEQ ID NO: 3400147 - protein, 21 aa, Plasmodium falciparum
KLSNDIKENVNSSTKSDNNNI

SEQ ID NO: 3400148 - protein, 23 aa, Plasmodium falciparum
KLSRRKNIRNDSNNSNNSNNRNN

SEQ ID NO: 3400149 - protein, 15 aa, Plasmodium falciparum
KMAGDQKKGNQNEKR

SEQ ID NO: 3400150 - protein, 4 aa, Plasmodium falciparum
KMED

SEQ ID NO: 3400151 - protein, 12 aa, Plasmodium falciparum
KMNNEEDNNKNI

SEQ ID NO: 3400152 - protein, 6 aa, Plasmodium falciparum
KMREEI

SEQ ID NO: 3400153 - protein, 6 aa, Plasmodium falciparum
KMSTND

SEQ ID NO: 3400154 - protein, 7 aa, Plasmodium falciparum
KNAKGLN

SEQ ID NO: 3400155 - protein, 11 aa, Plasmodium falciparum
KNANNQESSTV

SEQ ID NO: 3400156 - protein, 14 aa, Plasmodium falciparum
KNASSDDIKKSYRK

SEQ ID NO: 3400157 - protein, 8 aa, Plasmodium falciparum
KNAYGKEK

SEQ ID NO: 3400158 - protein, 5 aa, Plasmodium falciparum
KNCNF

SEQ ID NO: 3400159 - protein, 5 aa, Plasmodium falciparum
KNCSM

SEQ ID NO: 3400160 - protein, 6 aa, Plasmodium falciparum
KNCSPR

SEQ ID NO: 3400161 - protein, 14 aa, Plasmodium falciparum
KNCSSNLKKNQEEA

SEQ ID NO: 3400162 - protein, 8 aa, Plasmodium falciparum
KNDEMTED

SEQ ID NO: 3400163 - protein, 6 aa, Plasmodium falciparum
KNDENF

SEQ ID NO: 3400164 - protein, 16 aa, Plasmodium falciparum
KNDERRNDKKSEFFNT

SEQ ID NO: 3400165 - protein, 51 aa, Plasmodium falciparum
KNDIDGNMTRDDNMTRDDNMTSDDNMTRDGNRTNNDNITSDDNMSNDYDKI

SEQ ID NO: 3400166 - protein, 8 aa, Plasmodium falciparum
KNDKDKEI

SEQ ID NO: 3400167 - protein, 21 aa, Plasmodium falciparum
KNDKENKLNDFENNKNVERLN

SEQ ID NO: 3400168 - protein, 5 aa, Plasmodium falciparum
KNDKN

SEQ ID NO: 3400169 - protein, 8 aa, Plasmodium falciparum
KNDKNQGV

SEQ ID NO: 3400170 - protein, 8 aa, Plasmodium falciparum
KNDKTNIG

SEQ ID NO: 3400171 - protein, 7 aa, Plasmodium falciparum
KNDNERL

SEQ ID NO: 3400172 - protein, 5 aa, Plasmodium falciparum
KNDNV

SEQ ID NO: 3400173 - protein, 4 aa, Plasmodium falciparum
KNDP

SEQ ID NO: 3400174 - protein, 7 aa, Plasmodium falciparum
KNDPTFG

SEQ ID NO: 3400175 - protein, 10 aa, Plasmodium falciparum
KNDQNNNTLN

SEQ ID NO: 3400176 - protein, 8 aa, Plasmodium falciparum
KNDTNGKK

SEQ ID NO: 3400177 - protein, 13 aa, Plasmodium falciparum
KNDVKNNEDYKNV

SEQ ID NO: 3400178 - protein, 11 aa, Plasmodium falciparum
KNDVSDTSNEQ

SEQ ID NO: 3400179 - protein, 6 aa, Plasmodium falciparum
KNDYEM

SEQ ID NO: 3400180 - protein, 5 aa, Plasmodium falciparum
KNEDK

SEQ ID NO: 3400181 - protein, 16 aa, Plasmodium falciparum
KNEENRVGKLCINPQC

SEQ ID NO: 3400182 - protein, 7 aa, Plasmodium falciparum
KNEIEED

SEQ ID NO: 3400183 - protein, 4 aa, Plasmodium falciparum
KNEK

SEQ ID NO: 3400184 - protein, 6 aa, Plasmodium falciparum
KNEKTN

SEQ ID NO: 3400185 - protein, 4 aa, Plasmodium falciparum
KNEN

SEQ ID NO: 3400186 - protein, 7 aa, Plasmodium falciparum
KNENKHI

SEQ ID NO: 3400187 - protein, 6 aa, Plasmodium falciparum
KNEQNA

SEQ ID NO: 3400188 - protein, 9 aa, Plasmodium falciparum
KNEQREEDH

SEQ ID NO: 3400189 - protein, 8 aa, Plasmodium falciparum
KNESYRKK

SEQ ID NO: 3400190 - protein, 4 aa, Plasmodium falciparum
KNFK

SEQ ID NO: 3400191 - protein, 5 aa, Plasmodium falciparum
KNFNK

SEQ ID NO: 3400192 - protein, 11 aa, Plasmodium falciparum
KNFPADDNNRD

SEQ ID NO: 3400193 - protein, 8 aa, Plasmodium falciparum
KNFTPKDY

SEQ ID NO: 3400194 - protein, 8 aa, Plasmodium falciparum
KNGDPSTN

SEQ ID NO: 3400195 - protein, 5 aa, Plasmodium falciparum
KNGID

SEQ ID NO: 3400196 - protein, 6 aa, Plasmodium falciparum
KNGKKE

SEQ ID NO: 3400197 - protein, 8 aa, Plasmodium falciparum
KNGKKGEG

SEQ ID NO: 3400198 - protein, 7 aa, Plasmodium falciparum
KNGKNNK

SEQ ID NO: 3400199 - protein, 9 aa, Plasmodium falciparum
KNGKSKKYG

SEQ ID NO: 3400200 - protein, 11 aa, Plasmodium falciparum
KNGKVKKFSEG

SEQ ID NO: 3400201 - protein, 13 aa, Plasmodium falciparum
KNGNGDNESSQRV

SEQ ID NO: 3400202 - protein, 9 aa, Plasmodium falciparum
KNGNIQENK

SEQ ID NO: 3400203 - protein, 11 aa, Plasmodium falciparum
KNGSKKKKKNI

SEQ ID NO: 3400204 - protein, 11 aa, Plasmodium falciparum
KNGTKHPVYPT

SEQ ID NO: 3400205 - protein, 5 aa, Plasmodium falciparum
KNGVS

SEQ ID NO: 3400206 - protein, 5 aa, Plasmodium falciparum
KNHSN

SEQ ID NO: 3400207 - protein, 11 aa, Plasmodium falciparum
KNIDGYNNFEN

SEQ ID NO: 3400208 - protein, 14 aa, Plasmodium falciparum
KNIEEEGEESIKKD

SEQ ID NO: 3400209 - protein, 10 aa, Plasmodium falciparum
KNINQNKSTM

SEQ ID NO: 3400210 - protein, 6 aa, Plasmodium falciparum
KNIPPI

SEQ ID NO: 3400211 - protein, 44 aa, Plasmodium falciparum
KNIQSNEKNYNNHDNSNDINSNVNKSNDNSSSYKNIAKKKKDYI

SEQ ID NO: 3400212 - protein, 6 aa, Plasmodium falciparum
KNITTD

SEQ ID NO: 3400213 - protein, 16 aa, Plasmodium falciparum
KNIYNNNNNNNNNNKT

SEQ ID NO: 3400214 - protein, 5 aa, Plasmodium falciparum
KNKAS

SEQ ID NO: 3400215 - protein, 14 aa, Plasmodium falciparum
KNKEEKEKEKRKNN

SEQ ID NO: 3400216 - protein, 8 aa, Plasmodium falciparum
KNKEGEEK

SEQ ID NO: 3400217 - protein, 6 aa, Plasmodium falciparum
KNKELK

SEQ ID NO: 3400218 - protein, 6 aa, Plasmodium falciparum
KNKHER

SEQ ID NO: 3400219 - protein, 4 aa, Plasmodium falciparum
KNKK

SEQ ID NO: 3400220 - protein, 8 aa, Plasmodium falciparum
KNKKHSSQ

SEQ ID NO: 3400221 - protein, 5 aa, Plasmodium falciparum
KNKKI

SEQ ID NO: 3400222 - protein, 15 aa, Plasmodium falciparum
KNKKNNSASTNELSR

SEQ ID NO: 3400223 - protein, 11 aa, Plasmodium falciparum
KNKLTETSHNG

SEQ ID NO: 3400224 - protein, 8 aa, Plasmodium falciparum
KNKNASYS

SEQ ID NO: 3400225 - protein, 10 aa, Plasmodium falciparum
KNKNEYNSKL

SEQ ID NO: 3400226 - protein, 9 aa, Plasmodium falciparum
KNKNGNDIL

SEQ ID NO: 3400227 - protein, 29 aa, Plasmodium falciparum
KNKNNDSHNDDHNDGHNDGHNHNSDDTNF

SEQ ID NO: 3400228 - protein, 29 aa, Plasmodium falciparum
KNKNVKKEDDRKKGAKGNTKYPKSNGSNN

SEQ ID NO: 3400229 - protein, 120 aa, Plasmodium falciparum
KNKQNDEKKKDDNEKKKNDKQDIHDDNDDENDMEEIEENDDEEDEDEDMENKKKKKKGKNGNENGNENGSENGNENGNENGNENENKNESENENENENENENGNENENEKENEKDKNIKE

SEQ ID NO: 3400230 - protein, 8 aa, Plasmodium falciparum
KNKTGEKL

SEQ ID NO: 3400231 - protein, 37 aa, Plasmodium falciparum
KNKVSENDDDEKGNNNDDENDNDDSNDEEELDEEEDD

SEQ ID NO: 3400232 - protein, 6 aa, Plasmodium falciparum
KNKYSN

SEQ ID NO: 3400233 - protein, 7 aa, Plasmodium falciparum
KNLNKDL

SEQ ID NO: 3400234 - protein, 20 aa, Plasmodium falciparum
KNLRKIKETTDEEKTSDNVS

SEQ ID NO: 3400235 - protein, 4 aa, Plasmodium falciparum
KNLY

SEQ ID NO: 3400236 - protein, 14 aa, Plasmodium falciparum
KNMESNKMDEDPSD

SEQ ID NO: 3400237 - protein, 30 aa, Plasmodium falciparum
KNMNNNHAQRDQYDSDTLNSEGSDDAYSSM

SEQ ID NO: 3400238 - protein, 7 aa, Plasmodium falciparum
KNNDDEQ

SEQ ID NO: 3400239 - protein, 5 aa, Plasmodium falciparum
KNNDN

SEQ ID NO: 3400240 - protein, 4 aa, Plasmodium falciparum
KNNE

SEQ ID NO: 3400241 - protein, 6 aa, Plasmodium falciparum
KNNEEL

SEQ ID NO: 3400242 - protein, 8 aa, Plasmodium falciparum
KNNEKKCD

SEQ ID NO: 3400243 - protein, 12 aa, Plasmodium falciparum
KNNEKKKDDIVN

SEQ ID NO: 3400244 - protein, 4 aa, Plasmodium falciparum
KNNH

SEQ ID NO: 3400245 - protein, 8 aa, Plasmodium falciparum
KNNKEENN

SEQ ID NO: 3400246 - protein, 18 aa, Plasmodium falciparum
KNNKEQQEGGPNNESNGM

SEQ ID NO: 3400247 - protein, 14 aa, Plasmodium falciparum
KNNNHSGNINNNGE

SEQ ID NO: 3400248 - protein, 6 aa, Plasmodium falciparum
KNNNKK

SEQ ID NO: 3400249 - protein, 34 aa, Plasmodium falciparum
KNNNNNNNNNNNNNNTSNNNNISNNSNSNNSFGE

SEQ ID NO: 3400250 - protein, 7 aa, Plasmodium falciparum
KNNNQYN

SEQ ID NO: 3400251 - protein, 8 aa, Plasmodium falciparum
KNNQYSST

SEQ ID NO: 3400252 - protein, 12 aa, Plasmodium falciparum
KNNSEEKKEKKG

SEQ ID NO: 3400253 - protein, 21 aa, Plasmodium falciparum
KNNSENNTKSNSKNYSRGSSS

SEQ ID NO: 3400254 - protein, 6 aa, Plasmodium falciparum
KNNSTF

SEQ ID NO: 3400255 - protein, 20 aa, Plasmodium falciparum
KNNTDRDNNNLYETNNGDLK

SEQ ID NO: 3400256 - protein, 8 aa, Plasmodium falciparum
KNNTQKRY

SEQ ID NO: 3400257 - protein, 8 aa, Plasmodium falciparum
KNNYEEPI

SEQ ID NO: 3400258 - protein, 6 aa, Plasmodium falciparum
KNPDEL

SEQ ID NO: 3400259 - protein, 4 aa, Plasmodium falciparum
KNPE

SEQ ID NO: 3400260 - protein, 6 aa, Plasmodium falciparum
KNPETG

SEQ ID NO: 3400261 - protein, 7 aa, Plasmodium falciparum
KNPKKNN

SEQ ID NO: 3400262 - protein, 8 aa, Plasmodium falciparum
KNPTKYEI

SEQ ID NO: 3400263 - protein, 17 aa, Plasmodium falciparum
KNQDNSETNNISNDEEN

SEQ ID NO: 3400264 - protein, 10 aa, Plasmodium falciparum
KNQKQQESNE

SEQ ID NO: 3400265 - protein, 15 aa, Plasmodium falciparum
KNQNNNEKNVKEAAE

SEQ ID NO: 3400266 - protein, 10 aa, Plasmodium falciparum
KNQTKNNEKI

SEQ ID NO: 3400267 - protein, 4 aa, Plasmodium falciparum
KNQY

SEQ ID NO: 3400268 - protein, 7 aa, Plasmodium falciparum
KNREISN

SEQ ID NO: 3400269 - protein, 4 aa, Plasmodium falciparum
KNRN

SEQ ID NO: 3400270 - protein, 9 aa, Plasmodium falciparum
KNRTTKESR

SEQ ID NO: 3400271 - protein, 9 aa, Plasmodium falciparum
KNSEATKSG

SEQ ID NO: 3400272 - protein, 6 aa, Plasmodium falciparum
KNSISG

SEQ ID NO: 3400273 - protein, 21 aa, Plasmodium falciparum
KNSKNRRKYTNSYNSGSSTHS

SEQ ID NO: 3400274 - protein, 7 aa, Plasmodium falciparum
KNSQNYS

SEQ ID NO: 3400275 - protein, 9 aa, Plasmodium falciparum
KNSQQKKTY

SEQ ID NO: 3400276 - protein, 4 aa, Plasmodium falciparum
KNSR

SEQ ID NO: 3400277 - protein, 4 aa, Plasmodium falciparum
KNSW

SEQ ID NO: 3400278 - protein, 8 aa, Plasmodium falciparum
KNSYDGIP

SEQ ID NO: 3400279 - protein, 8 aa, Plasmodium falciparum
KNTEKDTN

SEQ ID NO: 3400280 - protein, 6 aa, Plasmodium falciparum
KNTENN

SEQ ID NO: 3400281 - protein, 6 aa, Plasmodium falciparum
KNTGKV

SEQ ID NO: 3400282 - protein, 6 aa, Plasmodium falciparum
KNTIQE

SEQ ID NO: 3400283 - protein, 8 aa, Plasmodium falciparum
KNTKNNIF

SEQ ID NO: 3400284 - protein, 6 aa, Plasmodium falciparum
KNTKYK

SEQ ID NO: 3400285 - protein, 6 aa, Plasmodium falciparum
KNTNIS

SEQ ID NO: 3400286 - protein, 6 aa, Plasmodium falciparum
KNTQTL

SEQ ID NO: 3400287 - protein, 6 aa, Plasmodium falciparum
KNTSIY

SEQ ID NO: 3400288 - protein, 9 aa, Plasmodium falciparum
KNTSNEYNN

SEQ ID NO: 3400289 - protein, 14 aa, Plasmodium falciparum
KNTTQTGNKDTNEM

SEQ ID NO: 3400290 - protein, 89 aa, Plasmodium falciparum
KNVDDDDESENDDMYESTTAGSSSETDNESDEEENDSSDNNNSDEEQIENSNNNNSDEEQNDSSSNDNNDEENEEQDDVMDNDQNDKKI

SEQ ID NO: 3400291 - protein, 5 aa, Plasmodium falciparum
KNVDT

SEQ ID NO: 3400292 - protein, 6 aa, Plasmodium falciparum
KNVERK

SEQ ID NO: 3400293 - protein, 9 aa, Plasmodium falciparum
KNVNNKEHD

SEQ ID NO: 3400294 - protein, 5 aa, Plasmodium falciparum
KNYDN

SEQ ID NO: 3400295 - protein, 7 aa, Plasmodium falciparum
KNYKDEK

SEQ ID NO: 3400296 - protein, 7 aa, Plasmodium falciparum
KNYLENK

SEQ ID NO: 3400297 - protein, 8 aa, Plasmodium falciparum
KNYQAQQK

SEQ ID NO: 3400298 - protein, 4 aa, Plasmodium falciparum
KNYT

SEQ ID NO: 3400299 - protein, 8 aa, Plasmodium falciparum
KPAKKYST

SEQ ID NO: 3400300 - protein, 9 aa, Plasmodium falciparum
KPANGNESS

SEQ ID NO: 3400301 - protein, 6 aa, Plasmodium falciparum
KPASVS

SEQ ID NO: 3400302 - protein, 13 aa, Plasmodium falciparum
KPDEKYKGPCKEA

SEQ ID NO: 3400303 - protein, 7 aa, Plasmodium falciparum
KPDNTTL

SEQ ID NO: 3400304 - protein, 6 aa, Plasmodium falciparum
KPDSHF

SEQ ID NO: 3400305 - protein, 7 aa, Plasmodium falciparum
KPDTLKN

SEQ ID NO: 3400306 - protein, 13 aa, Plasmodium falciparum
KPEISTPFTNDDY

SEQ ID NO: 3400307 - protein, 5 aa, Plasmodium falciparum
KPESM

SEQ ID NO: 3400308 - protein, 4 aa, Plasmodium falciparum
KPGK

SEQ ID NO: 3400309 - protein, 6 aa, Plasmodium falciparum
KPHIPD

SEQ ID NO: 3400310 - protein, 6 aa, Plasmodium falciparum
KPHKPG

SEQ ID NO: 3400311 - protein, 5 aa, Plasmodium falciparum
KPKFG

SEQ ID NO: 3400312 - protein, 6 aa, Plasmodium falciparum
KPKPLI

SEQ ID NO: 3400313 - protein, 6 aa, Plasmodium falciparum
KPKSPV

SEQ ID NO: 3400314 - protein, 7 aa, Plasmodium falciparum
KPLPNDD

SEQ ID NO: 3400315 - protein, 4 aa, Plasmodium falciparum
KPLQ

SEQ ID NO: 3400316 - protein, 4 aa, Plasmodium falciparum
KPLV

SEQ ID NO: 3400317 - protein, 4 aa, Plasmodium falciparum
KPND

SEQ ID NO: 3400318 - protein, 5 aa, Plasmodium falciparum
KPNEL

SEQ ID NO: 3400319 - protein, 7 aa, Plasmodium falciparum
KPNINEE

SEQ ID NO: 3400320 - protein, 6 aa, Plasmodium falciparum
KPNTDL

SEQ ID NO: 3400321 - protein, 7 aa, Plasmodium falciparum
KPSGGFT

SEQ ID NO: 3400322 - protein, 8 aa, Plasmodium falciparum
KPSNPQSV

SEQ ID NO: 3400323 - protein, 6 aa, Plasmodium falciparum
KPTEFE

SEQ ID NO: 3400324 - protein, 13 aa, Plasmodium falciparum
KPTFTKRNNTNVQ

SEQ ID NO: 3400325 - protein, 7 aa, Plasmodium falciparum
KPTKGVQ

SEQ ID NO: 3400326 - protein, 6 aa, Plasmodium falciparum
KPTRNI

SEQ ID NO: 3400327 - protein, 14 aa, Plasmodium falciparum
KPTRTQSSPHITES

SEQ ID NO: 3400328 - protein, 5 aa, Plasmodium falciparum
KPVND

SEQ ID NO: 3400329 - protein, 6 aa, Plasmodium falciparum
KPWDTT

SEQ ID NO: 3400330 - protein, 4 aa, Plasmodium falciparum
KPYS

SEQ ID NO: 3400331 - protein, 10 aa, Plasmodium falciparum
KQASKENKNV

SEQ ID NO: 3400332 - protein, 6 aa, Plasmodium falciparum
KQDCKR

SEQ ID NO: 3400333 - protein, 9 aa, Plasmodium falciparum
KQDNDFSND

SEQ ID NO: 3400334 - protein, 6 aa, Plasmodium falciparum
KQEELK

SEQ ID NO: 3400335 - protein, 17 aa, Plasmodium falciparum
KQENNNKEEENKSKSLQ

SEQ ID NO: 3400336 - protein, 4 aa, Plasmodium falciparum
KQEP

SEQ ID NO: 3400337 - protein, 15 aa, Plasmodium falciparum
KQFNNSTKRLKATEY

SEQ ID NO: 3400338 - protein, 11 aa, Plasmodium falciparum
KQGESPTYTKK

SEQ ID NO: 3400339 - protein, 15 aa, Plasmodium falciparum
KQGSNTIVGSGNGSG

SEQ ID NO: 3400340 - protein, 12 aa, Plasmodium falciparum
KQHSSNQGYEKA

SEQ ID NO: 3400341 - protein, 8 aa, Plasmodium falciparum
KQIENEEQ

SEQ ID NO: 3400342 - protein, 7 aa, Plasmodium falciparum
KQKDYTN

SEQ ID NO: 3400343 - protein, 16 aa, Plasmodium falciparum
KQKETKKQQQQQQQKK

SEQ ID NO: 3400344 - protein, 6 aa, Plasmodium falciparum
KQKPVV

SEQ ID NO: 3400345 - protein, 6 aa, Plasmodium falciparum
KQKTRT

SEQ ID NO: 3400346 - protein, 13 aa, Plasmodium falciparum
KQLRKSAEKPIGK

SEQ ID NO: 3400347 - protein, 6 aa, Plasmodium falciparum
KQMENK

SEQ ID NO: 3400348 - protein, 6 aa, Plasmodium falciparum
KQNDNL

SEQ ID NO: 3400349 - protein, 6 aa, Plasmodium falciparum
KQNKSD

SEQ ID NO: 3400350 - protein, 20 aa, Plasmodium falciparum
KQNNNNNNNNNNNNNNNYYN

SEQ ID NO: 3400351 - protein, 5 aa, Plasmodium falciparum
KQNRN

SEQ ID NO: 3400352 - protein, 8 aa, Plasmodium falciparum
KQNSHLSE

SEQ ID NO: 3400353 - protein, 9 aa, Plasmodium falciparum
KQPKMPSGF

SEQ ID NO: 3400354 - protein, 20 aa, Plasmodium falciparum
KQSKNDKSSEESLKKKIEDD

SEQ ID NO: 3400355 - protein, 5 aa, Plasmodium falciparum
KQTCK

SEQ ID NO: 3400356 - protein, 17 aa, Plasmodium falciparum
KQTRSDESSGVKKDDEM

SEQ ID NO: 3400357 - protein, 4 aa, Plasmodium falciparum
KQWP

SEQ ID NO: 3400358 - protein, 6 aa, Plasmodium falciparum
KQYTDS

SEQ ID NO: 3400359 - protein, 5 aa, Plasmodium falciparum
KRDGN

SEQ ID NO: 3400360 - protein, 6 aa, Plasmodium falciparum
KRDSNF

SEQ ID NO: 3400361 - protein, 6 aa, Plasmodium falciparum
KREQKV

SEQ ID NO: 3400362 - protein, 10 aa, Plasmodium falciparum
KRERKNKKYK

SEQ ID NO: 3400363 - protein, 5 aa, Plasmodium falciparum
KRGEG

SEQ ID NO: 3400364 - protein, 5 aa, Plasmodium falciparum
KRGKG

SEQ ID NO: 3400365 - protein, 85 aa, Plasmodium falciparum
KRGNMGINSEGDDNNNNNSDDDNNINSDDNNSNSDDNNSNSDDNNSNSDDNNSNSDDNNINSDDNNINSGDDNNLKDKDKGNIGN

SEQ ID NO: 3400366 - protein, 10 aa, Plasmodium falciparum
KRGNSKNRFS

SEQ ID NO: 3400367 - protein, 5 aa, Plasmodium falciparum
KRGTQ

SEQ ID NO: 3400368 - protein, 16 aa, Plasmodium falciparum
KRKAQEKGLPEPTVTN

SEQ ID NO: 3400369 - protein, 5 aa, Plasmodium falciparum
KRKDK

SEQ ID NO: 3400370 - protein, 6 aa, Plasmodium falciparum
KRKEKK

SEQ ID NO: 3400371 - protein, 22 aa, Plasmodium falciparum
KRKEQIKKGPSASEGEMVPDEE

SEQ ID NO: 3400372 - protein, 9 aa, Plasmodium falciparum
KRKITSSEY

SEQ ID NO: 3400373 - protein, 24 aa, Plasmodium falciparum
KRKKKSSLNSSKSESDSSVPTELE

SEQ ID NO: 3400374 - protein, 4 aa, Plasmodium falciparum
KRKV

SEQ ID NO: 3400375 - protein, 5 aa, Plasmodium falciparum
KRLEE

SEQ ID NO: 3400376 - protein, 7 aa, Plasmodium falciparum
KRLGQPI

SEQ ID NO: 3400377 - protein, 8 aa, Plasmodium falciparum
KRMEEDKK

SEQ ID NO: 3400378 - protein, 11 aa, Plasmodium falciparum
KRNATKEDISK

SEQ ID NO: 3400379 - protein, 5 aa, Plasmodium falciparum
KRNKK

SEQ ID NO: 3400380 - protein, 5 aa, Plasmodium falciparum
KRNKN

SEQ ID NO: 3400381 - protein, 42 aa, Plasmodium falciparum
KRNNDPEEQNKLEEERKKGEEEQNKLEEERKKREEEKSNDTF

SEQ ID NO: 3400382 - protein, 23 aa, Plasmodium falciparum
KRNNKNEDNHELQSKSRSLKGTE

SEQ ID NO: 3400383 - protein, 8 aa, Plasmodium falciparum
KRNNNKNV

SEQ ID NO: 3400384 - protein, 7 aa, Plasmodium falciparum
KRNRSNI

SEQ ID NO: 3400385 - protein, 5 aa, Plasmodium falciparum
KRNTN

SEQ ID NO: 3400386 - protein, 8 aa, Plasmodium falciparum
KRNTNNNA

SEQ ID NO: 3400387 - protein, 8 aa, Plasmodium falciparum
KRNVEKNN

SEQ ID NO: 3400388 - protein, 4 aa, Plasmodium falciparum
KRQL

SEQ ID NO: 3400389 - protein, 11 aa, Plasmodium falciparum
KRQTNKNIKSK

SEQ ID NO: 3400390 - protein, 6 aa, Plasmodium falciparum
KRRVQE

SEQ ID NO: 3400391 - protein, 18 aa, Plasmodium falciparum
KRSDPMKGKPKSNTSPLP

SEQ ID NO: 3400392 - protein, 4 aa, Plasmodium falciparum
KRSE

SEQ ID NO: 3400393 - protein, 5 aa, Plasmodium falciparum
KRSGD

SEQ ID NO: 3400394 - protein, 5 aa, Plasmodium falciparum
KRSKK

SEQ ID NO: 3400395 - protein, 6 aa, Plasmodium falciparum
KRSNQV

SEQ ID NO: 3400396 - protein, 18 aa, Plasmodium falciparum
KRSYEGPCSTNELREQST

SEQ ID NO: 3400397 - protein, 6 aa, Plasmodium falciparum
KSAHRR

SEQ ID NO: 3400398 - protein, 12 aa, Plasmodium falciparum
KSANSQEKDYDK

SEQ ID NO: 3400399 - protein, 8 aa, Plasmodium falciparum
KSAYPSDP

SEQ ID NO: 3400400 - protein, 6 aa, Plasmodium falciparum
KSCSSQ

SEQ ID NO: 3400401 - protein, 15 aa, Plasmodium falciparum
KSDDETDYNENKQGA

SEQ ID NO: 3400402 - protein, 9 aa, Plasmodium falciparum
KSDGENGEN

SEQ ID NO: 3400403 - protein, 5 aa, Plasmodium falciparum
KSDKD

SEQ ID NO: 3400404 - protein, 30 aa, Plasmodium falciparum
KSDNKKKSKKRKTIRGSIKSSNGLIIRPKN

SEQ ID NO: 3400405 - protein, 6 aa, Plasmodium falciparum
KSDNNN

SEQ ID NO: 3400406 - protein, 8 aa, Plasmodium falciparum
KSDQPVQQ

SEQ ID NO: 3400407 - protein, 6 aa, Plasmodium falciparum
KSDRAE

SEQ ID NO: 3400408 - protein, 6 aa, Plasmodium falciparum
KSDYGS

SEQ ID NO: 3400409 - protein, 7 aa, Plasmodium falciparum
KSEEEDV

SEQ ID NO: 3400410 - protein, 8 aa, Plasmodium falciparum
KSEKQSQL

SEQ ID NO: 3400411 - protein, 28 aa, Plasmodium falciparum
KSENVDVSKEVESPVRKSEEKPVSKTVQ

SEQ ID NO: 3400412 - protein, 5 aa, Plasmodium falciparum
KSEQN

SEQ ID NO: 3400413 - protein, 8 aa, Plasmodium falciparum
KSERNMNP

SEQ ID NO: 3400414 - protein, 7 aa, Plasmodium falciparum
KSESTYY

SEQ ID NO: 3400415 - protein, 37 aa, Plasmodium falciparum
KSETTTDESATGSLSSDGSRVTTQARIEKPKQQPTLP

SEQ ID NO: 3400416 - protein, 9 aa, Plasmodium falciparum
KSGNTIEYR

SEQ ID NO: 3400417 - protein, 8 aa, Plasmodium falciparum
KSGNTSNN

SEQ ID NO: 3400418 - protein, 11 aa, Plasmodium falciparum
KSGYELGPGTI

SEQ ID NO: 3400419 - protein, 17 aa, Plasmodium falciparum
KSHNEENISNNEYSSSM

SEQ ID NO: 3400420 - protein, 24 aa, Plasmodium falciparum
KSIDYAKQKKSEKKEDQQEDDDGF

SEQ ID NO: 3400421 - protein, 4 aa, Plasmodium falciparum
KSIE

SEQ ID NO: 3400422 - protein, 8 aa, Plasmodium falciparum
KSIKEAKE

SEQ ID NO: 3400423 - protein, 10 aa, Plasmodium falciparum
KSINTESNKP

SEQ ID NO: 3400424 - protein, 6 aa, Plasmodium falciparum
KSIPNK

SEQ ID NO: 3400425 - protein, 5 aa, Plasmodium falciparum
KSIQK

SEQ ID NO: 3400426 - protein, 4 aa, Plasmodium falciparum
KSKD

SEQ ID NO: 3400427 - protein, 4 aa, Plasmodium falciparum
KSKM

SEQ ID NO: 3400428 - protein, 15 aa, Plasmodium falciparum
KSKTRKDNKKDIEKK

SEQ ID NO: 3400429 - protein, 7 aa, Plasmodium falciparum
KSKTYPK

SEQ ID NO: 3400430 - protein, 10 aa, Plasmodium falciparum
KSLNESVSRQ

SEQ ID NO: 3400431 - protein, 5 aa, Plasmodium falciparum
KSLPS

SEQ ID NO: 3400432 - protein, 13 aa, Plasmodium falciparum
KSMESKKNIESGK

SEQ ID NO: 3400433 - protein, 9 aa, Plasmodium falciparum
KSNAHCPTS

SEQ ID NO: 3400434 - protein, 5 aa, Plasmodium falciparum
KSNCP

SEQ ID NO: 3400435 - protein, 7 aa, Plasmodium falciparum
KSNKIKR

SEQ ID NO: 3400436 - protein, 25 aa, Plasmodium falciparum
KSNKINSKGLEKSDKNKKSKEKDNG

SEQ ID NO: 3400437 - protein, 7 aa, Plasmodium falciparum
KSNNDSN

SEQ ID NO: 3400438 - protein, 22 aa, Plasmodium falciparum
KSNNNSNNVHENNNIDHSNNYN

SEQ ID NO: 3400439 - protein, 9 aa, Plasmodium falciparum
KSNNSQNEY

SEQ ID NO: 3400440 - protein, 8 aa, Plasmodium falciparum
KSNPYDSK

SEQ ID NO: 3400441 - protein, 6 aa, Plasmodium falciparum
KSNQNY

SEQ ID NO: 3400442 - protein, 4 aa, Plasmodium falciparum
KSPI

SEQ ID NO: 3400443 - protein, 8 aa, Plasmodium falciparum
KSPRRKGR

SEQ ID NO: 3400444 - protein, 23 aa, Plasmodium falciparum
KSQDIEKNNKELSNKMDTQDSKQ

SEQ ID NO: 3400445 - protein, 5 aa, Plasmodium falciparum
KSREN

SEQ ID NO: 3400446 - protein, 5 aa, Plasmodium falciparum
KSRET

SEQ ID NO: 3400447 - protein, 8 aa, Plasmodium falciparum
KSRKKNKK

SEQ ID NO: 3400448 - protein, 7 aa, Plasmodium falciparum
KSRNDVP

SEQ ID NO: 3400449 - protein, 7 aa, Plasmodium falciparum
KSSEIQG

SEQ ID NO: 3400450 - protein, 5 aa, Plasmodium falciparum
KSSII

SEQ ID NO: 3400451 - protein, 5 aa, Plasmodium falciparum
KSSIT

SEQ ID NO: 3400452 - protein, 5 aa, Plasmodium falciparum
KSSLK

SEQ ID NO: 3400453 - protein, 10 aa, Plasmodium falciparum
KSSTKGYGSM

SEQ ID NO: 3400454 - protein, 9 aa, Plasmodium falciparum
KSSTKHNSD

SEQ ID NO: 3400455 - protein, 6 aa, Plasmodium falciparum
KSSTYG

SEQ ID NO: 3400456 - protein, 6 aa, Plasmodium falciparum
KSSYND

SEQ ID NO: 3400457 - protein, 5 aa, Plasmodium falciparum
KSTAF

SEQ ID NO: 3400458 - protein, 6 aa, Plasmodium falciparum
KSTDLD

SEQ ID NO: 3400459 - protein, 4 aa, Plasmodium falciparum
KSTI

SEQ ID NO: 3400460 - protein, 6 aa, Plasmodium falciparum
KSTIPR

SEQ ID NO: 3400461 - protein, 8 aa, Plasmodium falciparum
KSTKNEKD

SEQ ID NO: 3400462 - protein, 12 aa, Plasmodium falciparum
KSTLKKGENDWN

SEQ ID NO: 3400463 - protein, 5 aa, Plasmodium falciparum
KSTND

SEQ ID NO: 3400464 - protein, 7 aa, Plasmodium falciparum
KSTQEAD

SEQ ID NO: 3400465 - protein, 51 aa, Plasmodium falciparum
KSTSCQTDESRDAPGGDQNESLDEKDSMEKSKEKKKKKGKSRKKNKDTNLT

SEQ ID NO: 3400466 - protein, 7 aa, Plasmodium falciparum
KSTYGNR

SEQ ID NO: 3400467 - protein, 7 aa, Plasmodium falciparum
KSVSEPA

SEQ ID NO: 3400468 - protein, 13 aa, Plasmodium falciparum
KSYTNSNNGHNNI

SEQ ID NO: 3400469 - protein, 7 aa, Plasmodium falciparum
KTAGKNL

SEQ ID NO: 3400470 - protein, 6 aa, Plasmodium falciparum
KTAQSI

SEQ ID NO: 3400471 - protein, 10 aa, Plasmodium falciparum
KTEKIRNPYT

SEQ ID NO: 3400472 - protein, 10 aa, Plasmodium falciparum
KTEQEELEEK

SEQ ID NO: 3400473 - protein, 4 aa, Plasmodium falciparum
KTFV

SEQ ID NO: 3400474 - protein, 5 aa, Plasmodium falciparum
KTGTG

SEQ ID NO: 3400475 - protein, 8 aa, Plasmodium falciparum
KTGTPPRL

SEQ ID NO: 3400476 - protein, 10 aa, Plasmodium falciparum
KTGVTEKNYS

SEQ ID NO: 3400477 - protein, 10 aa, Plasmodium falciparum
KTKDKKTENV

SEQ ID NO: 3400478 - protein, 17 aa, Plasmodium falciparum
KTKEQNNCNEQNLNDDD

SEQ ID NO: 3400479 - protein, 8 aa, Plasmodium falciparum
KTKKPYSN

SEQ ID NO: 3400480 - protein, 5 aa, Plasmodium falciparum
KTKNM

SEQ ID NO: 3400481 - protein, 10 aa, Plasmodium falciparum
KTKYSNTSVP

SEQ ID NO: 3400482 - protein, 11 aa, Plasmodium falciparum
KTLGLRKRSSS

SEQ ID NO: 3400483 - protein, 7 aa, Plasmodium falciparum
KTLNDEE

SEQ ID NO: 3400484 - protein, 32 aa, Plasmodium falciparum
KTLTNNEKNEDNKIPHIDPSNNELDKKGNYNK

SEQ ID NO: 3400485 - protein, 5 aa, Plasmodium falciparum
KTMNT

SEQ ID NO: 3400486 - protein, 11 aa, Plasmodium falciparum
KTNDESKKNKI

SEQ ID NO: 3400487 - protein, 5 aa, Plasmodium falciparum
KTNDT

SEQ ID NO: 3400488 - protein, 15 aa, Plasmodium falciparum
KTNKHKKEGTPNSIH

SEQ ID NO: 3400489 - protein, 7 aa, Plasmodium falciparum
KTNPTQT

SEQ ID NO: 3400490 - protein, 6 aa, Plasmodium falciparum
KTNQAN

SEQ ID NO: 3400491 - protein, 16 aa, Plasmodium falciparum
KTNQHNNKKNKKDRYI

SEQ ID NO: 3400492 - protein, 6 aa, Plasmodium falciparum
KTNSLE

SEQ ID NO: 3400493 - protein, 21 aa, Plasmodium falciparum
KTNTSENRNKRIGGPKLRGNV

SEQ ID NO: 3400494 - protein, 5 aa, Plasmodium falciparum
KTQEN

SEQ ID NO: 3400495 - protein, 6 aa, Plasmodium falciparum
KTQKNE

SEQ ID NO: 3400496 - protein, 5 aa, Plasmodium falciparum
KTQYP

SEQ ID NO: 3400497 - protein, 8 aa, Plasmodium falciparum
KTRKAAEE

SEQ ID NO: 3400498 - protein, 5 aa, Plasmodium falciparum
KTSDD

SEQ ID NO: 3400499 - protein, 6 aa, Plasmodium falciparum
KTSENY

SEQ ID NO: 3400500 - protein, 4 aa, Plasmodium falciparum
KTSF

SEQ ID NO: 3400501 - protein, 10 aa, Plasmodium falciparum
KTSNNDKKKI

SEQ ID NO: 3400502 - protein, 29 aa, Plasmodium falciparum
KTSSNKASLRKTTTIDSGRIQKKYKSVIF

SEQ ID NO: 3400503 - protein, 6 aa, Plasmodium falciparum
KTTEKI

SEQ ID NO: 3400504 - protein, 9 aa, Plasmodium falciparum
KTVPSTANG

SEQ ID NO: 3400505 - protein, 4 aa, Plasmodium falciparum
KTYS

SEQ ID NO: 3400506 - protein, 77 aa, Plasmodium falciparum
KVDEPNKMEEHNKMEEHNKMEEHNKMEEHNKMEEHNKMEEHNKMEEHNKMEEHNKMEEHNKMEEHNKMEEHNKMEEH

SEQ ID NO: 3400507 - protein, 10 aa, Plasmodium falciparum
KVGEEGKDEK

SEQ ID NO: 3400508 - protein, 20 aa, Plasmodium falciparum
KVGKKSKKKKINKNGNNKKY

SEQ ID NO: 3400509 - protein, 6 aa, Plasmodium falciparum
KVKGEE

SEQ ID NO: 3400510 - protein, 48 aa, Plasmodium falciparum
KVKNETKNREIEKKNNISNNNRSKNNRSNNSKSNNTRANNNRTIDNEP

SEQ ID NO: 3400511 - protein, 10 aa, Plasmodium falciparum
KVKNTDEGLS

SEQ ID NO: 3400512 - protein, 11 aa, Plasmodium falciparum
KVKREKRNGRG

SEQ ID NO: 3400513 - protein, 7 aa, Plasmodium falciparum
KVNHGNT

SEQ ID NO: 3400514 - protein, 9 aa, Plasmodium falciparum
KVNKSYEEK

SEQ ID NO: 3400515 - protein, 7 aa, Plasmodium falciparum
KVNLSDE

SEQ ID NO: 3400516 - protein, 27 aa, Plasmodium falciparum
KVPINNNNMESSNQNNNPNNNTTNIQT

SEQ ID NO: 3400517 - protein, 6 aa, Plasmodium falciparum
KVRSRS

SEQ ID NO: 3400518 - protein, 6 aa, Plasmodium falciparum
KVSNKD

SEQ ID NO: 3400519 - protein, 10 aa, Plasmodium falciparum
KVVKKGNDIV

SEQ ID NO: 3400520 - protein, 7 aa, Plasmodium falciparum
KYARTDE

SEQ ID NO: 3400521 - protein, 5 aa, Plasmodium falciparum
KYDSF

SEQ ID NO: 3400522 - protein, 5 aa, Plasmodium falciparum
KYDSN

SEQ ID NO: 3400523 - protein, 11 aa, Plasmodium falciparum
KYEDEEQIKKE

SEQ ID NO: 3400524 - protein, 11 aa, Plasmodium falciparum
KYEEKNITQGV

SEQ ID NO: 3400525 - protein, 11 aa, Plasmodium falciparum
KYEETNKENEH

SEQ ID NO: 3400526 - protein, 6 aa, Plasmodium falciparum
KYEGEC

SEQ ID NO: 3400527 - protein, 4 aa, Plasmodium falciparum
KYEI

SEQ ID NO: 3400528 - protein, 5 aa, Plasmodium falciparum
KYEKD

SEQ ID NO: 3400529 - protein, 11 aa, Plasmodium falciparum
KYELENAKAGD

SEQ ID NO: 3400530 - protein, 6 aa, Plasmodium falciparum
KYEQDI

SEQ ID NO: 3400531 - protein, 7 aa, Plasmodium falciparum
KYGGPYN

SEQ ID NO: 3400532 - protein, 4 aa, Plasmodium falciparum
KYGK

SEQ ID NO: 3400533 - protein, 6 aa, Plasmodium falciparum
KYGTYD

SEQ ID NO: 3400534 - protein, 11 aa, Plasmodium falciparum
KYHEKEKRKDN

SEQ ID NO: 3400535 - protein, 8 aa, Plasmodium falciparum
KYKEEKNF

SEQ ID NO: 3400536 - protein, 12 aa, Plasmodium falciparum
KYKNKKNKNQEF

SEQ ID NO: 3400537 - protein, 4 aa, Plasmodium falciparum
KYKS

SEQ ID NO: 3400538 - protein, 6 aa, Plasmodium falciparum
KYNLKP

SEQ ID NO: 3400539 - protein, 15 aa, Plasmodium falciparum
KYNNNHNNNDDDEEY

SEQ ID NO: 3400540 - protein, 7 aa, Plasmodium falciparum
KYNTFSK

SEQ ID NO: 3400541 - protein, 7 aa, Plasmodium falciparum
KYNTNKK

SEQ ID NO: 3400542 - protein, 11 aa, Plasmodium falciparum
KYNTQEKKENI

SEQ ID NO: 3400543 - protein, 6 aa, Plasmodium falciparum
KYRGEF

SEQ ID NO: 3400544 - protein, 12 aa, Plasmodium falciparum
KYRKEKDEEINN

SEQ ID NO: 3400545 - protein, 8 aa, Plasmodium falciparum
KYSKDGSI

SEQ ID NO: 3400546 - protein, 9 aa, Plasmodium falciparum
KYSKKNPNE

SEQ ID NO: 3400547 - protein, 12 aa, Plasmodium falciparum
KYSSENNSRIGE

SEQ ID NO: 3400548 - protein, 7 aa, Plasmodium falciparum
KYSTNKN

SEQ ID NO: 3400549 - protein, 6 aa, Plasmodium falciparum
KYTEKM

SEQ ID NO: 3400550 - protein, 40 aa, Plasmodium falciparum
KYTNSGKSSKTHEGNNEKHEMSENDINSNNNYDNNKEEKG

SEQ ID NO: 3400551 - protein, 11 aa, Plasmodium falciparum
LAKDNKKMSDT

SEQ ID NO: 3400552 - protein, 7 aa, Plasmodium falciparum
LANDENF

SEQ ID NO: 3400553 - protein, 63 aa, Plasmodium falciparum
LAPKNKEEEEKEKEKEEKEKEEKEKEKEEKEKEEKEKEEKEKEEKEEEKKEKEEEQEEEEEEE

SEQ ID NO: 3400554 - protein, 7 aa, Plasmodium falciparum
LAPPEMQ

SEQ ID NO: 3400555 - protein, 5 aa, Plasmodium falciparum
LAQKN

SEQ ID NO: 3400556 - protein, 10 aa, Plasmodium falciparum
LAQSGGLGSN

SEQ ID NO: 3400557 - protein, 8 aa, Plasmodium falciparum
LCGPDTEK

SEQ ID NO: 3400558 - protein, 12 aa, Plasmodium falciparum
LDAEQNTKKGEH

SEQ ID NO: 3400559 - protein, 4 aa, Plasmodium falciparum
LDDY

SEQ ID NO: 3400560 - protein, 14 aa, Plasmodium falciparum
LDEDELSDTENYYD

SEQ ID NO: 3400561 - protein, 6 aa, Plasmodium falciparum
LDEEEY

SEQ ID NO: 3400562 - protein, 9 aa, Plasmodium falciparum
LDENTTTVE

SEQ ID NO: 3400563 - protein, 4 aa, Plasmodium falciparum
LDES

SEQ ID NO: 3400564 - protein, 18 aa, Plasmodium falciparum
LDESDDLSDPESKTKEDN

SEQ ID NO: 3400565 - protein, 8 aa, Plasmodium falciparum
LDESKKIK

SEQ ID NO: 3400566 - protein, 14 aa, Plasmodium falciparum
LDGHSINNNTPLNN

SEQ ID NO: 3400567 - protein, 6 aa, Plasmodium falciparum
LDITPS

SEQ ID NO: 3400568 - protein, 4 aa, Plasmodium falciparum
LDNK

SEQ ID NO: 3400569 - protein, 9 aa, Plasmodium falciparum
LDNKKTTEY

SEQ ID NO: 3400570 - protein, 19 aa, Plasmodium falciparum
LDNPENTNNAHQVSDEDDN

SEQ ID NO: 3400571 - protein, 8 aa, Plasmodium falciparum
LDNTKNGK

SEQ ID NO: 3400572 - protein, 7 aa, Plasmodium falciparum
LDSSGTI

SEQ ID NO: 3400573 - protein, 8 aa, Plasmodium falciparum
LDTENKAH

SEQ ID NO: 3400574 - protein, 5 aa, Plasmodium falciparum
LDTSH

SEQ ID NO: 3400575 - protein, 40 aa, Plasmodium falciparum
LEDSKEKSDDASEKIDGAIKKSDKSINKSDKDNKKLNSIE

SEQ ID NO: 3400576 - protein, 25 aa, Plasmodium falciparum
LEEKNKTFKGEDEDLDSNEQKLEES

SEQ ID NO: 3400577 - protein, 10 aa, Plasmodium falciparum
LEESDRYKEP

SEQ ID NO: 3400578 - protein, 9 aa, Plasmodium falciparum
LEHNDGRSS

SEQ ID NO: 3400579 - protein, 12 aa, Plasmodium falciparum
LEKEDTLSYDNS

SEQ ID NO: 3400580 - protein, 10 aa, Plasmodium falciparum
LEKEKRHKDI

SEQ ID NO: 3400581 - protein, 9 aa, Plasmodium falciparum
LEKKEKKAM

SEQ ID NO: 3400582 - protein, 24 aa, Plasmodium falciparum
LEKQKKKNKLDEVDKEYEEEQKTH

SEQ ID NO: 3400583 - protein, 8 aa, Plasmodium falciparum
LENNSGNK

SEQ ID NO: 3400584 - protein, 5 aa, Plasmodium falciparum
LENSS

SEQ ID NO: 3400585 - protein, 6 aa, Plasmodium falciparum
LEPQRN

SEQ ID NO: 3400586 - protein, 13 aa, Plasmodium falciparum
LGATYGTRQKEMN

SEQ ID NO: 3400587 - protein, 7 aa, Plasmodium falciparum
LGDTDPI

SEQ ID NO: 3400588 - protein, 4 aa, Plasmodium falciparum
LGEA

SEQ ID NO: 3400589 - protein, 7 aa, Plasmodium falciparum
LGGEEKL

SEQ ID NO: 3400590 - protein, 6 aa, Plasmodium falciparum
LGGGGH

SEQ ID NO: 3400591 - protein, 10 aa, Plasmodium falciparum
LGKDDHDLEH

SEQ ID NO: 3400592 - protein, 10 aa, Plasmodium falciparum
LGKDHTKDEY

SEQ ID NO: 3400593 - protein, 9 aa, Plasmodium falciparum
LGKDKGYSE

SEQ ID NO: 3400594 - protein, 12 aa, Plasmodium falciparum
LGKKEESRSNCA

SEQ ID NO: 3400595 - protein, 5 aa, Plasmodium falciparum
LGNDK

SEQ ID NO: 3400596 - protein, 4 aa, Plasmodium falciparum
LGPG

SEQ ID NO: 3400597 - protein, 7 aa, Plasmodium falciparum
LGRDKKI

SEQ ID NO: 3400598 - protein, 7 aa, Plasmodium falciparum
LGSDNNT

SEQ ID NO: 3400599 - protein, 7 aa, Plasmodium falciparum
LGSPTED

SEQ ID NO: 3400600 - protein, 7 aa, Plasmodium falciparum
LGSSKDD

SEQ ID NO: 3400601 - protein, 10 aa, Plasmodium falciparum
LKDRKKNNGV

SEQ ID NO: 3400602 - protein, 6 aa, Plasmodium falciparum
LKEAQQ

SEQ ID NO: 3400603 - protein, 11 aa, Plasmodium falciparum
LKEEHSKETIK

SEQ ID NO: 3400604 - protein, 5 aa, Plasmodium falciparum
LKEEK

SEQ ID NO: 3400605 - protein, 11 aa, Plasmodium falciparum
LKEEKKTNTPF

SEQ ID NO: 3400606 - protein, 7 aa, Plasmodium falciparum
LKEKAER

SEQ ID NO: 3400607 - protein, 5 aa, Plasmodium falciparum
LKEKE

SEQ ID NO: 3400608 - protein, 6 aa, Plasmodium falciparum
LKEKNT

SEQ ID NO: 3400609 - protein, 7 aa, Plasmodium falciparum
LKERSKN

SEQ ID NO: 3400610 - protein, 19 aa, Plasmodium falciparum
LKGAAKRAGLEISEDGKSR

SEQ ID NO: 3400611 - protein, 5 aa, Plasmodium falciparum
LKGAQ

SEQ ID NO: 3400612 - protein, 6 aa, Plasmodium falciparum
LKGNGF

SEQ ID NO: 3400613 - protein, 36 aa, Plasmodium falciparum
LKGQKERTKRLQKKTSDEQEIKNDENDQEKSKKSYF

SEQ ID NO: 3400614 - protein, 5 aa, Plasmodium falciparum
LKKED

SEQ ID NO: 3400615 - protein, 5 aa, Plasmodium falciparum
LKKKE

SEQ ID NO: 3400616 - protein, 13 aa, Plasmodium falciparum
LKKNEEKKKENME

SEQ ID NO: 3400617 - protein, 9 aa, Plasmodium falciparum
LKKNNKGEC

SEQ ID NO: 3400618 - protein, 16 aa, Plasmodium falciparum
LKKTGETIDQKGKKGF

SEQ ID NO: 3400619 - protein, 6 aa, Plasmodium falciparum
LKNEKS

SEQ ID NO: 3400620 - protein, 6 aa, Plasmodium falciparum
LKNKNV

SEQ ID NO: 3400621 - protein, 8 aa, Plasmodium falciparum
LKNNNKGT

SEQ ID NO: 3400622 - protein, 11 aa, Plasmodium falciparum
LKNSSNPVDEN

SEQ ID NO: 3400623 - protein, 7 aa, Plasmodium falciparum
LKNTPDE

SEQ ID NO: 3400624 - protein, 8 aa, Plasmodium falciparum
LKNTQNKN

SEQ ID NO: 3400625 - protein, 10 aa, Plasmodium falciparum
LKPTESGPKV

SEQ ID NO: 3400626 - protein, 21 aa, Plasmodium falciparum
LKQDEKKNKKYKQEESLKEVN

SEQ ID NO: 3400627 - protein, 6 aa, Plasmodium falciparum
LKQSSS

SEQ ID NO: 3400628 - protein, 7 aa, Plasmodium falciparum
LKSPKKK

SEQ ID NO: 3400629 - protein, 5 aa, Plasmodium falciparum
LKSPY

SEQ ID NO: 3400630 - protein, 58 aa, Plasmodium falciparum
LKSQENNNSLNQNKFNDNNNNNNDDDNNEDDNNEDEHEEDMNGVNNQNGNYDNTQNNI

SEQ ID NO: 3400631 - protein, 22 aa, Plasmodium falciparum
LKSTDASLKIPEKNKVQTNKSR

SEQ ID NO: 3400632 - protein, 5 aa, Plasmodium falciparum
LKTKA

SEQ ID NO: 3400633 - protein, 7 aa, Plasmodium falciparum
LKTQDKS

SEQ ID NO: 3400634 - protein, 6 aa, Plasmodium falciparum
LKYGGS

SEQ ID NO: 3400635 - protein, 14 aa, Plasmodium falciparum
LNEDDNVSNNSYDN

SEQ ID NO: 3400636 - protein, 19 aa, Plasmodium falciparum
LNENSDSHNMSNKKNVSNF

SEQ ID NO: 3400637 - protein, 5 aa, Plasmodium falciparum
LNKDE

SEQ ID NO: 3400638 - protein, 6 aa, Plasmodium falciparum
LNKNRD

SEQ ID NO: 3400639 - protein, 8 aa, Plasmodium falciparum
LNKPQDHE

SEQ ID NO: 3400640 - protein, 17 aa, Plasmodium falciparum
LNNGRDYKYNEDHPFSS

SEQ ID NO: 3400641 - protein, 19 aa, Plasmodium falciparum
LNNNNNNNNVSNKGYNNQR

SEQ ID NO: 3400642 - protein, 8 aa, Plasmodium falciparum
LNNPIPSD

SEQ ID NO: 3400643 - protein, 6 aa, Plasmodium falciparum
LNNPKK

SEQ ID NO: 3400644 - protein, 33 aa, Plasmodium falciparum
LNNRNNWSNTNNPKDDNIKNTNCSTNDEGQKKY

SEQ ID NO: 3400645 - protein, 11 aa, Plasmodium falciparum
LNPSTSSASSI

SEQ ID NO: 3400646 - protein, 15 aa, Plasmodium falciparum
LNREKEKKKKKSDIH

SEQ ID NO: 3400647 - protein, 27 aa, Plasmodium falciparum
LNSKKDNNKYNNNNNNENNNNHNINND

SEQ ID NO: 3400648 - protein, 7 aa, Plasmodium falciparum
LNTDYNN

SEQ ID NO: 3400649 - protein, 6 aa, Plasmodium falciparum
LNTNDN

SEQ ID NO: 3400650 - protein, 74 aa, Plasmodium falciparum
LNYENENKNNNNNNNNNKSNQEMEKNNIDDKSSTGNNKNINGNSKGNNNINNNNKNKNSSSSSSSSSNYNNNEG

SEQ ID NO: 3400651 - protein, 9 aa, Plasmodium falciparum
LPDKKSNMK

SEQ ID NO: 3400652 - protein, 5 aa, Plasmodium falciparum
LPENK

SEQ ID NO: 3400653 - protein, 10 aa, Plasmodium falciparum
LPESRRTSGE

SEQ ID NO: 3400654 - protein, 4 aa, Plasmodium falciparum
LPGD

SEQ ID NO: 3400655 - protein, 7 aa, Plasmodium falciparum
LPIDDPK

SEQ ID NO: 3400656 - protein, 4 aa, Plasmodium falciparum
LPKH

SEQ ID NO: 3400657 - protein, 9 aa, Plasmodium falciparum
LPKQDRENI

SEQ ID NO: 3400658 - protein, 37 aa, Plasmodium falciparum
LPNDNISPSNDLPNDNISPSNDLPNDNISPSNDPPSF

SEQ ID NO: 3400659 - protein, 8 aa, Plasmodium falciparum
LPNDTKKI

SEQ ID NO: 3400660 - protein, 19 aa, Plasmodium falciparum
LPPPPPPVPPPPPPTLTPS

SEQ ID NO: 3400661 - protein, 9 aa, Plasmodium falciparum
LPSAKNNCE

SEQ ID NO: 3400662 - protein, 5 aa, Plasmodium falciparum
LPSNE

SEQ ID NO: 3400663 - protein, 7 aa, Plasmodium falciparum
LPSNEGR

SEQ ID NO: 3400664 - protein, 71 aa, Plasmodium falciparum
LPSNGTTGEQGSSTGTVRGDTEPISDSSSSSSSSSSSSSSSSSSSSSSSSSSSESLPANGPDSPTVKPPRN

SEQ ID NO: 3400665 - protein, 7 aa, Plasmodium falciparum
LPSSPSG

SEQ ID NO: 3400666 - protein, 12 aa, Plasmodium falciparum
LPTESNYPYDQS

SEQ ID NO: 3400667 - protein, 13 aa, Plasmodium falciparum
LPTESNYPYDQSK

SEQ ID NO: 3400668 - protein, 7 aa, Plasmodium falciparum
LPYGKTN

SEQ ID NO: 3400669 - protein, 43 aa, Plasmodium falciparum
LPYSNENKIEEQNKISDENKINEKKNKNIENKEEYKNTEPSNV

SEQ ID NO: 3400670 - protein, 6 aa, Plasmodium falciparum
LQEGKE

SEQ ID NO: 3400671 - protein, 4 aa, Plasmodium falciparum
LQEI

SEQ ID NO: 3400672 - protein, 27 aa, Plasmodium falciparum
LQEKHEQSQKQKEKEIKDRRNKLLSLR

SEQ ID NO: 3400673 - protein, 11 aa, Plasmodium falciparum
LQENEDDEDNV

SEQ ID NO: 3400674 - protein, 17 aa, Plasmodium falciparum
LQHRKRPRKRKKSSIYP

SEQ ID NO: 3400675 - protein, 10 aa, Plasmodium falciparum
LQNDTYDETR

SEQ ID NO: 3400676 - protein, 34 aa, Plasmodium falciparum
LQNEQNVQNEQNVQNEQNVQNVQNEQNVQNEQNV

SEQ ID NO: 3400677 - protein, 5 aa, Plasmodium falciparum
LQNNN

SEQ ID NO: 3400678 - protein, 5 aa, Plasmodium falciparum
LQNSE

SEQ ID NO: 3400679 - protein, 12 aa, Plasmodium falciparum
LQQSNKDTPIHK

SEQ ID NO: 3400680 - protein, 8 aa, Plasmodium falciparum
LQRGASNL

SEQ ID NO: 3400681 - protein, 87 aa, Plasmodium falciparum
LQSGKNEQDINKNEKGKQDISNSNAENKKDVKEGVKELEEKKKEEKISDDHKVEENKKSDDHKVEENKKSDDHKVEENKKSDDHKIE

SEQ ID NO: 3400682 - protein, 14 aa, Plasmodium falciparum
LQTNKNNDNIREEK

SEQ ID NO: 3400683 - protein, 15 aa, Plasmodium falciparum
LRNENDNKTLEEEQN

SEQ ID NO: 3400684 - protein, 17 aa, Plasmodium falciparum
LRRSNGTSMRKAREGSL

SEQ ID NO: 3400685 - protein, 4 aa, Plasmodium falciparum
LRSK

SEQ ID NO: 3400686 - protein, 4 aa, Plasmodium falciparum
LRSQ

SEQ ID NO: 3400687 - protein, 4 aa, Plasmodium falciparum
LSCP

SEQ ID NO: 3400688 - protein, 6 aa, Plasmodium falciparum
LSDNKI

SEQ ID NO: 3400689 - protein, 7 aa, Plasmodium falciparum
LSEDPVE

SEQ ID NO: 3400690 - protein, 6 aa, Plasmodium falciparum
LSEEGL

SEQ ID NO: 3400691 - protein, 9 aa, Plasmodium falciparum
LSEKKPWAA

SEQ ID NO: 3400692 - protein, 13 aa, Plasmodium falciparum
LSEPNNSRNSNLY

SEQ ID NO: 3400693 - protein, 6 aa, Plasmodium falciparum
LSEQHK

SEQ ID NO: 3400694 - protein, 5 aa, Plasmodium falciparum
LSGDL

SEQ ID NO: 3400695 - protein, 4 aa, Plasmodium falciparum
LSGN

SEQ ID NO: 3400696 - protein, 8 aa, Plasmodium falciparum
LSKKDQVK

SEQ ID NO: 3400697 - protein, 5 aa, Plasmodium falciparum
LSKNN

SEQ ID NO: 3400698 - protein, 4 aa, Plasmodium falciparum
LSKR

SEQ ID NO: 3400699 - protein, 12 aa, Plasmodium falciparum
LSNDGENYKEVS

SEQ ID NO: 3400700 - protein, 8 aa, Plasmodium falciparum
LSNDSRIS

SEQ ID NO: 3400701 - protein, 5 aa, Plasmodium falciparum
LSNEE

SEQ ID NO: 3400702 - protein, 8 aa, Plasmodium falciparum
LSNNGDKV

SEQ ID NO: 3400703 - protein, 8 aa, Plasmodium falciparum
LSNTEPRE

SEQ ID NO: 3400704 - protein, 5 aa, Plasmodium falciparum
LSQSD

SEQ ID NO: 3400705 - protein, 9 aa, Plasmodium falciparum
LSSPNSNYQ

SEQ ID NO: 3400706 - protein, 6 aa, Plasmodium falciparum
LSSRDE

SEQ ID NO: 3400707 - protein, 23 aa, Plasmodium falciparum
LSSSENEQNDGNVNKKQNNTAGS

SEQ ID NO: 3400708 - protein, 12 aa, Plasmodium falciparum
LSSSSPNSTNKE

SEQ ID NO: 3400709 - protein, 5 aa, Plasmodium falciparum
LSSST

SEQ ID NO: 3400710 - protein, 6 aa, Plasmodium falciparum
LSTEEN

SEQ ID NO: 3400711 - protein, 6 aa, Plasmodium falciparum
LSTPIK

SEQ ID NO: 3400712 - protein, 12 aa, Plasmodium falciparum
LTDEQKKVLADL

SEQ ID NO: 3400713 - protein, 24 aa, Plasmodium falciparum
LTDTSTSNKSSKKGHGRSRVRSAS

SEQ ID NO: 3400714 - protein, 5 aa, Plasmodium falciparum
LTEST

SEQ ID NO: 3400715 - protein, 6 aa, Plasmodium falciparum
LTETTG

SEQ ID NO: 3400716 - protein, 5 aa, Plasmodium falciparum
LTKQN

SEQ ID NO: 3400717 - protein, 9 aa, Plasmodium falciparum
LTQEEKSQN

SEQ ID NO: 3400718 - protein, 5 aa, Plasmodium falciparum
LTSEE

SEQ ID NO: 3400719 - protein, 9 aa, Plasmodium falciparum
LTSQTKTNC

SEQ ID NO: 3400720 - protein, 20 aa, Plasmodium falciparum
LTTSGKINKNKNLKERKKKN

SEQ ID NO: 3400721 - protein, 5 aa, Plasmodium falciparum
LYDPN

SEQ ID NO: 3400722 - protein, 9 aa, Plasmodium falciparum
LYNRNSNYT

SEQ ID NO: 3400723 - protein, 8 aa, Plasmodium falciparum
LYSPDTYT

SEQ ID NO: 3400724 - protein, 6 aa, Plasmodium falciparum
LYSTNN

SEQ ID NO: 3400725 - protein, 14 aa, Plasmodium falciparum
MDVKEGAKEEYTDL

SEQ ID NO: 3400726 - protein, 10 aa, Plasmodium falciparum
MDYGPNDKLT

SEQ ID NO: 3400727 - protein, 84 aa, Plasmodium falciparum
MEDKNGVTKSSGHEQNDRGNYDDEKYDQYYDDEKYDQYYDDDEKYDQYYDDDEKYDQYYDDDEKCGDKKYDKNYEKKKNSSHEN

SEQ ID NO: 3400728 - protein, 23 aa, Plasmodium falciparum
MEKAKQDKKKALEKIGKESDEEP

SEQ ID NO: 3400729 - protein, 4 aa, Plasmodium falciparum
MENK

SEQ ID NO: 3400730 - protein, 21 aa, Plasmodium falciparum
METSKLEKKEEVDEVTQDEEF

SEQ ID NO: 3400731 - protein, 17 aa, Plasmodium falciparum
MGEEDGVEDSKNYEMNN

SEQ ID NO: 3400732 - protein, 13 aa, Plasmodium falciparum
MGNYQNQENEEND

SEQ ID NO: 3400733 - protein, 10 aa, Plasmodium falciparum
MHNNEKNTFN

SEQ ID NO: 3400734 - protein, 6 aa, Plasmodium falciparum
MKKPEN

SEQ ID NO: 3400735 - protein, 6 aa, Plasmodium falciparum
MKNNEE

SEQ ID NO: 3400736 - protein, 9 aa, Plasmodium falciparum
MKPTDGSFD

SEQ ID NO: 3400737 - protein, 12 aa, Plasmodium falciparum
MKYEDETKRTTK

SEQ ID NO: 3400738 - protein, 46 aa, Plasmodium falciparum
MNDPKDDVKNETFNNDVNKGNNKTNIDYNSNNNGNNNNNNNYNEYD

SEQ ID NO: 3400739 - protein, 4 aa, Plasmodium falciparum
MNEE

SEQ ID NO: 3400740 - protein, 6 aa, Plasmodium falciparum
MNEPPY

SEQ ID NO: 3400741 - protein, 7 aa, Plasmodium falciparum
MNNNEQA

SEQ ID NO: 3400742 - protein, 24 aa, Plasmodium falciparum
MNNNNNNNNNNNNNNNNNNNNIND

SEQ ID NO: 3400743 - protein, 7 aa, Plasmodium falciparum
MNNPKRP

SEQ ID NO: 3400744 - protein, 19 aa, Plasmodium falciparum
MNNSTEKKINSISKGNNNI

SEQ ID NO: 3400745 - protein, 83 aa, Plasmodium falciparum
MNPNNKSVSSINTNLSDSSNNKNDNSLNSKKNDNTLNSKKNDNTLNSKKNDNTLNSKNNNNSLNSKNNNNSLNSKKSNNSYND

SEQ ID NO: 3400746 - protein, 17 aa, Plasmodium falciparum
MNQEEDEDEEYENNKNN

SEQ ID NO: 3400747 - protein, 8 aa, Plasmodium falciparum
MNRSSRSI

SEQ ID NO: 3400748 - protein, 9 aa, Plasmodium falciparum
MNSSSDLEK

SEQ ID NO: 3400749 - protein, 5 aa, Plasmodium falciparum
MNTSG

SEQ ID NO: 3400750 - protein, 10 aa, Plasmodium falciparum
MPEAKPNNDI

SEQ ID NO: 3400751 - protein, 55 aa, Plasmodium falciparum
MPGNDSDSNDNETGDVDNDKNNELGNANDNNEMNNENAESKNMQGENSNNQEQLN

SEQ ID NO: 3400752 - protein, 7 aa, Plasmodium falciparum
MPPSGGL

SEQ ID NO: 3400753 - protein, 8 aa, Plasmodium falciparum
MSEKRKEK

SEQ ID NO: 3400754 - protein, 43 aa, Plasmodium falciparum
MSKRREVEREKDHIKGNSKNKNKKKNKNKKKNKNKKKNKNKNF

SEQ ID NO: 3400755 - protein, 4 aa, Plasmodium falciparum
MSKS

SEQ ID NO: 3400756 - protein, 9 aa, Plasmodium falciparum
MSNGEQPEL

SEQ ID NO: 3400757 - protein, 5 aa, Plasmodium falciparum
MSQDD

SEQ ID NO: 3400758 - protein, 7 aa, Plasmodium falciparum
MSSPSAS

SEQ ID NO: 3400759 - protein, 10 aa, Plasmodium falciparum
MSTNKNNNQI

SEQ ID NO: 3400760 - protein, 4 aa, Plasmodium falciparum
MSYE

SEQ ID NO: 3400761 - protein, 6 aa, Plasmodium falciparum
MTNEQK

SEQ ID NO: 3400762 - protein, 12 aa, Plasmodium falciparum
MTSNEMNNETTH

SEQ ID NO: 3400763 - protein, 10 aa, Plasmodium falciparum
NAEEDGEDKI

SEQ ID NO: 3400764 - protein, 8 aa, Plasmodium falciparum
NAKGLNSN

SEQ ID NO: 3400765 - protein, 8 aa, Plasmodium falciparum
NAKTHTGK

SEQ ID NO: 3400766 - protein, 5 aa, Plasmodium falciparum
NAKYS

SEQ ID NO: 3400767 - protein, 6 aa, Plasmodium falciparum
NALTRG

SEQ ID NO: 3400768 - protein, 18 aa, Plasmodium falciparum
NANKLPKWNQPSKEGKKI

SEQ ID NO: 3400769 - protein, 5 aa, Plasmodium falciparum
NANNE

SEQ ID NO: 3400770 - protein, 7 aa, Plasmodium falciparum
NAPTNVI

SEQ ID NO: 3400771 - protein, 13 aa, Plasmodium falciparum
NARNQPGDEEASY

SEQ ID NO: 3400772 - protein, 39 aa, Plasmodium falciparum
NASAQGSVKATTEKNGTKPISKRNEQVNNQTINRPTYNS

SEQ ID NO: 3400773 - protein, 7 aa, Plasmodium falciparum
NATETND

SEQ ID NO: 3400774 - protein, 13 aa, Plasmodium falciparum
NATKKCGCGKSFN

SEQ ID NO: 3400775 - protein, 8 aa, Plasmodium falciparum
NATNNYEK

SEQ ID NO: 3400776 - protein, 38 aa, Plasmodium falciparum
NATSKEIQKDEQKNLRNGSSINNNKNIENKNDNIETQY

SEQ ID NO: 3400777 - protein, 8 aa, Plasmodium falciparum
NATVEQTK

SEQ ID NO: 3400778 - protein, 8 aa, Plasmodium falciparum
NAVPSSNR

SEQ ID NO: 3400779 - protein, 6 aa, Plasmodium falciparum
NCNTND

SEQ ID NO: 3400780 - protein, 12 aa, Plasmodium falciparum
NCSHPKSSTPDI

SEQ ID NO: 3400781 - protein, 11 aa, Plasmodium falciparum
NCTNNNDNYND

SEQ ID NO: 3400782 - protein, 6 aa, Plasmodium falciparum
NDAEDY

SEQ ID NO: 3400783 - protein, 6 aa, Plasmodium falciparum
NDCEGA

SEQ ID NO: 3400784 - protein, 6 aa, Plasmodium falciparum
NDDEIG

SEQ ID NO: 3400785 - protein, 6 aa, Plasmodium falciparum
NDDGTY

SEQ ID NO: 3400786 - protein, 4 aa, Plasmodium falciparum
NDDM

SEQ ID NO: 3400787 - protein, 47 aa, Plasmodium falciparum
NDDNNNNDNNNNNNNDNDNNNNNNDNNNNNNDNNNNNEEQEKGKDNT

SEQ ID NO: 3400788 - protein, 10 aa, Plasmodium falciparum
NDDRRNKGNI

SEQ ID NO: 3400789 - protein, 5 aa, Plasmodium falciparum
NDDSC

SEQ ID NO: 3400790 - protein, 7 aa, Plasmodium falciparum
NDDSSQS

SEQ ID NO: 3400791 - protein, 10 aa, Plasmodium falciparum
NDDTSGMSTF

SEQ ID NO: 3400792 - protein, 25 aa, Plasmodium falciparum
NDEDEPTNNINSNENNKNQNNNNNN

SEQ ID NO: 3400793 - protein, 7 aa, Plasmodium falciparum
NDEEKEK

SEQ ID NO: 3400794 - protein, 9 aa, Plasmodium falciparum
NDEERKNHE

SEQ ID NO: 3400795 - protein, 6 aa, Plasmodium falciparum
NDEHQK

SEQ ID NO: 3400796 - protein, 12 aa, Plasmodium falciparum
NDEMNTKHLKWR

SEQ ID NO: 3400797 - protein, 5 aa, Plasmodium falciparum
NDEPD

SEQ ID NO: 3400798 - protein, 5 aa, Plasmodium falciparum
NDEPI

SEQ ID NO: 3400799 - protein, 6 aa, Plasmodium falciparum
NDEQHN

SEQ ID NO: 3400800 - protein, 17 aa, Plasmodium falciparum
NDESDQYDINDDDTTDD

SEQ ID NO: 3400801 - protein, 10 aa, Plasmodium falciparum
NDGKEYNNSE

SEQ ID NO: 3400802 - protein, 27 aa, Plasmodium falciparum
NDGVHGATEDRKKARPQKIKGPNQERV

SEQ ID NO: 3400803 - protein, 12 aa, Plasmodium falciparum
NDHTTNESNISN

SEQ ID NO: 3400804 - protein, 17 aa, Plasmodium falciparum
NDIKGSKNSKGSKNHNN

SEQ ID NO: 3400805 - protein, 8 aa, Plasmodium falciparum
NDINNNEE

SEQ ID NO: 3400806 - protein, 5 aa, Plasmodium falciparum
NDINT

SEQ ID NO: 3400807 - protein, 5 aa, Plasmodium falciparum
NDIPT

SEQ ID NO: 3400808 - protein, 5 aa, Plasmodium falciparum
NDISR

SEQ ID NO: 3400809 - protein, 8 aa, Plasmodium falciparum
NDKDKPSM

SEQ ID NO: 3400810 - protein, 4 aa, Plasmodium falciparum
NDKE

SEQ ID NO: 3400811 - protein, 9 aa, Plasmodium falciparum
NDKGRLSKE

SEQ ID NO: 3400812 - protein, 4 aa, Plasmodium falciparum
NDKH

SEQ ID NO: 3400813 - protein, 8 aa, Plasmodium falciparum
NDKKEELF

SEQ ID NO: 3400814 - protein, 28 aa, Plasmodium falciparum
NDKKEQKENNTSDHNNPYEQNKNINNKR

SEQ ID NO: 3400815 - protein, 9 aa, Plasmodium falciparum
NDKKPESTY

SEQ ID NO: 3400816 - protein, 5 aa, Plasmodium falciparum
NDKNI

SEQ ID NO: 3400817 - protein, 10 aa, Plasmodium falciparum
NDKNKEEIKD

SEQ ID NO: 3400818 - protein, 7 aa, Plasmodium falciparum
NDKTKDK

SEQ ID NO: 3400819 - protein, 4 aa, Plasmodium falciparum
NDLC

SEQ ID NO: 3400820 - protein, 5 aa, Plasmodium falciparum
NDLQE

SEQ ID NO: 3400821 - protein, 15 aa, Plasmodium falciparum
NDLYNPSDKLYNNND

SEQ ID NO: 3400822 - protein, 9 aa, Plasmodium falciparum
NDMNSQPKQ

SEQ ID NO: 3400823 - protein, 5 aa, Plasmodium falciparum
NDNHY

SEQ ID NO: 3400824 - protein, 6 aa, Plasmodium falciparum
NDNKNF

SEQ ID NO: 3400825 - protein, 5 aa, Plasmodium falciparum
NDNLE

SEQ ID NO: 3400826 - protein, 4 aa, Plasmodium falciparum
NDNN

SEQ ID NO: 3400827 - protein, 6 aa, Plasmodium falciparum
NDNNHI

SEQ ID NO: 3400828 - protein, 8 aa, Plasmodium falciparum
NDNNKSKK

SEQ ID NO: 3400829 - protein, 17 aa, Plasmodium falciparum
NDNSEKKKDMEESNNYS

SEQ ID NO: 3400830 - protein, 15 aa, Plasmodium falciparum
NDPELKKEKEKERNQ

SEQ ID NO: 3400831 - protein, 14 aa, Plasmodium falciparum
NDPLDDDKNNEDEK

SEQ ID NO: 3400832 - protein, 11 aa, Plasmodium falciparum
NDPNKKEKIKE

SEQ ID NO: 3400833 - protein, 6 aa, Plasmodium falciparum
NDPNYD

SEQ ID NO: 3400834 - protein, 9 aa, Plasmodium falciparum
NDRNEENDL

SEQ ID NO: 3400835 - protein, 8 aa, Plasmodium falciparum
NDRQKNEF

SEQ ID NO: 3400836 - protein, 6 aa, Plasmodium falciparum
NDSINN

SEQ ID NO: 3400837 - protein, 6 aa, Plasmodium falciparum
NDSKSD

SEQ ID NO: 3400838 - protein, 7 aa, Plasmodium falciparum
NDSNEIN

SEQ ID NO: 3400839 - protein, 13 aa, Plasmodium falciparum
NDSNKNQEYTNND

SEQ ID NO: 3400840 - protein, 17 aa, Plasmodium falciparum
NDSQTTSDNYKNERYQI

SEQ ID NO: 3400841 - protein, 6 aa, Plasmodium falciparum
NDSRTV

SEQ ID NO: 3400842 - protein, 6 aa, Plasmodium falciparum
NDTITT

SEQ ID NO: 3400843 - protein, 10 aa, Plasmodium falciparum
NDVDRNDKEY

SEQ ID NO: 3400844 - protein, 4 aa, Plasmodium falciparum
NDVN

SEQ ID NO: 3400845 - protein, 4 aa, Plasmodium falciparum
NDVR

SEQ ID NO: 3400846 - protein, 4 aa, Plasmodium falciparum
NEAK

SEQ ID NO: 3400847 - protein, 4 aa, Plasmodium falciparum
NEAN

SEQ ID NO: 3400848 - protein, 8 aa, Plasmodium falciparum
NECAPSEY

SEQ ID NO: 3400849 - protein, 31 aa, Plasmodium falciparum
NEDDNHAQNEGSINAPSEGEHNNTDNKEGPI

SEQ ID NO: 3400850 - protein, 16 aa, Plasmodium falciparum
NEDGTTKPNAPTAQSL

SEQ ID NO: 3400851 - protein, 4 aa, Plasmodium falciparum
NEDI

SEQ ID NO: 3400852 - protein, 29 aa, Plasmodium falciparum
NEDTNEDTNKDTEIEDQRKRKLTKNNDNH

SEQ ID NO: 3400853 - protein, 9 aa, Plasmodium falciparum
NEDVTDTES

SEQ ID NO: 3400854 - protein, 4 aa, Plasmodium falciparum
NEDY

SEQ ID NO: 3400855 - protein, 4 aa, Plasmodium falciparum
NEEC

SEQ ID NO: 3400856 - protein, 36 aa, Plasmodium falciparum
NEEDENQVENRKQNENGNVNGNGNVNENVNENINEN

SEQ ID NO: 3400857 - protein, 30 aa, Plasmodium falciparum
NEEEKEKGIKKNDTDKLESKNDNEHKNEEN

SEQ ID NO: 3400858 - protein, 32 aa, Plasmodium falciparum
NEEESVTSETINKHDSSVKVKGRRKKNITSNE

SEQ ID NO: 3400859 - protein, 13 aa, Plasmodium falciparum
NEEEVKNAKDEKD

SEQ ID NO: 3400860 - protein, 8 aa, Plasmodium falciparum
NEEGLSDD

SEQ ID NO: 3400861 - protein, 10 aa, Plasmodium falciparum
NEEKLNENNK

SEQ ID NO: 3400862 - protein, 16 aa, Plasmodium falciparum
NEEKMKESKDLPEPTI

SEQ ID NO: 3400863 - protein, 8 aa, Plasmodium falciparum
NEEKNNGK

SEQ ID NO: 3400864 - protein, 30 aa, Plasmodium falciparum
NEEKQKKKEMDKNEEVKKSDELTKEGKIER

SEQ ID NO: 3400865 - protein, 4 aa, Plasmodium falciparum
NEEL

SEQ ID NO: 3400866 - protein, 5 aa, Plasmodium falciparum
NEENE

SEQ ID NO: 3400867 - protein, 17 aa, Plasmodium falciparum
NEESKIPNDKSANSKLA

SEQ ID NO: 3400868 - protein, 5 aa, Plasmodium falciparum
NEESN

SEQ ID NO: 3400869 - protein, 6 aa, Plasmodium falciparum
NEGISG

SEQ ID NO: 3400870 - protein, 12 aa, Plasmodium falciparum
NEHKKNNKKDDY

SEQ ID NO: 3400871 - protein, 8 aa, Plasmodium falciparum
NEHPNNQR

SEQ ID NO: 3400872 - protein, 22 aa, Plasmodium falciparum
NEHTTNHPIESHTGENNHDKIN

SEQ ID NO: 3400873 - protein, 4 aa, Plasmodium falciparum
NEIG

SEQ ID NO: 3400874 - protein, 51 aa, Plasmodium falciparum
NEIGENGKNGKNEENEKNGKNGKNEKNEENGKNGKNEKNEENEKNKQPEGI

SEQ ID NO: 3400875 - protein, 16 aa, Plasmodium falciparum
NEIKKEKEKEKESDRK

SEQ ID NO: 3400876 - protein, 7 aa, Plasmodium falciparum
NEINEND

SEQ ID NO: 3400877 - protein, 7 aa, Plasmodium falciparum
NEINSTD

SEQ ID NO: 3400878 - protein, 4 aa, Plasmodium falciparum
NEIY

SEQ ID NO: 3400879 - protein, 4 aa, Plasmodium falciparum
NEKC

SEQ ID NO: 3400880 - protein, 6 aa, Plasmodium falciparum
NEKEEI

SEQ ID NO: 3400881 - protein, 7 aa, Plasmodium falciparum
NEKEEIN

SEQ ID NO: 3400882 - protein, 12 aa, Plasmodium falciparum
NEKEERKRINDD

SEQ ID NO: 3400883 - protein, 5 aa, Plasmodium falciparum
NEKEN

SEQ ID NO: 3400884 - protein, 23 aa, Plasmodium falciparum
NEKENYNQDVSQDVSQDVSQDIN

SEQ ID NO: 3400885 - protein, 87 aa, Plasmodium falciparum
NEKESDNDEEEEEDEEDNEDNNTNNNNNNNNNNNNDDDHHNDDDHHDNNDNHDNDNNDNNNNNNDNNNNNNDNNNNNNDNNNNSSAA

SEQ ID NO: 3400886 - protein, 4 aa, Plasmodium falciparum
NEKF

SEQ ID NO: 3400887 - protein, 4 aa, Plasmodium falciparum
NEKI

SEQ ID NO: 3400888 - protein, 5 aa, Plasmodium falciparum
NEKIT

SEQ ID NO: 3400889 - protein, 5 aa, Plasmodium falciparum
NEKKK

SEQ ID NO: 3400890 - protein, 10 aa, Plasmodium falciparum
NEKKKNNEIN

SEQ ID NO: 3400891 - protein, 6 aa, Plasmodium falciparum
NEKNDE

SEQ ID NO: 3400892 - protein, 5 aa, Plasmodium falciparum
NEKNE

SEQ ID NO: 3400893 - protein, 8 aa, Plasmodium falciparum
NEKNENEV

SEQ ID NO: 3400894 - protein, 6 aa, Plasmodium falciparum
NEKQKS

SEQ ID NO: 3400895 - protein, 7 aa, Plasmodium falciparum
NEKRNIE

SEQ ID NO: 3400896 - protein, 5 aa, Plasmodium falciparum
NEKSK

SEQ ID NO: 3400897 - protein, 11 aa, Plasmodium falciparum
NEKSKTNESLV

SEQ ID NO: 3400898 - protein, 14 aa, Plasmodium falciparum
NEKYDDQKKSKNIN

SEQ ID NO: 3400899 - protein, 6 aa, Plasmodium falciparum
NEKYDK

SEQ ID NO: 3400900 - protein, 9 aa, Plasmodium falciparum
NELKKKKKN

SEQ ID NO: 3400901 - protein, 5 aa, Plasmodium falciparum
NELPN

SEQ ID NO: 3400902 - protein, 4 aa, Plasmodium falciparum
NENK

SEQ ID NO: 3400903 - protein, 5 aa, Plasmodium falciparum
NENKN

SEQ ID NO: 3400904 - protein, 12 aa, Plasmodium falciparum
NENLKEKEKNKE

SEQ ID NO: 3400905 - protein, 4 aa, Plasmodium falciparum
NENN

SEQ ID NO: 3400906 - protein, 5 aa, Plasmodium falciparum
NENNI

SEQ ID NO: 3400907 - protein, 6 aa, Plasmodium falciparum
NENQSK

SEQ ID NO: 3400908 - protein, 6 aa, Plasmodium falciparum
NENSRS

SEQ ID NO: 3400909 - protein, 4 aa, Plasmodium falciparum
NENT

SEQ ID NO: 3400910 - protein, 8 aa, Plasmodium falciparum
NENYGNNI

SEQ ID NO: 3400911 - protein, 29 aa, Plasmodium falciparum
NEQEDEEGEQTDQEQNGVDEKEKKEQKYI

SEQ ID NO: 3400912 - protein, 24 aa, Plasmodium falciparum
NEQKTSSSNNNKEKECIDTNGNNN

SEQ ID NO: 3400913 - protein, 4 aa, Plasmodium falciparum
NERG

SEQ ID NO: 3400914 - protein, 5 aa, Plasmodium falciparum
NERGK

SEQ ID NO: 3400915 - protein, 5 aa, Plasmodium falciparum
NERKG

SEQ ID NO: 3400916 - protein, 9 aa, Plasmodium falciparum
NERNEKVDK

SEQ ID NO: 3400917 - protein, 4 aa, Plasmodium falciparum
NERS

SEQ ID NO: 3400918 - protein, 15 aa, Plasmodium falciparum
NESKHTKEERVKEEK

SEQ ID NO: 3400919 - protein, 14 aa, Plasmodium falciparum
NESNESGPFPTGDV

SEQ ID NO: 3400920 - protein, 11 aa, Plasmodium falciparum
NESNNKRQKEK

SEQ ID NO: 3400921 - protein, 17 aa, Plasmodium falciparum
NESSKNKRAKVKNENDV

SEQ ID NO: 3400922 - protein, 36 aa, Plasmodium falciparum
NETDINENKYNDIKSSNTKNNDQQNKNVNKHNNNNN

SEQ ID NO: 3400923 - protein, 4 aa, Plasmodium falciparum
NETP

SEQ ID NO: 3400924 - protein, 5 aa, Plasmodium falciparum
NETYV

SEQ ID NO: 3400925 - protein, 7 aa, Plasmodium falciparum
NEVDKGV

SEQ ID NO: 3400926 - protein, 7 aa, Plasmodium falciparum
NEVGNEK

SEQ ID NO: 3400927 - protein, 7 aa, Plasmodium falciparum
NEVNTNN

SEQ ID NO: 3400928 - protein, 7 aa, Plasmodium falciparum
NEYQKYS

SEQ ID NO: 3400929 - protein, 8 aa, Plasmodium falciparum
NEYTNEEK

SEQ ID NO: 3400930 - protein, 5 aa, Plasmodium falciparum
NFANG

SEQ ID NO: 3400931 - protein, 8 aa, Plasmodium falciparum
NFEQDNED

SEQ ID NO: 3400932 - protein, 7 aa, Plasmodium falciparum
NFGGADN

SEQ ID NO: 3400933 - protein, 7 aa, Plasmodium falciparum
NFGNEDG

SEQ ID NO: 3400934 - protein, 8 aa, Plasmodium falciparum
NFNGTGGL

SEQ ID NO: 3400935 - protein, 18 aa, Plasmodium falciparum
NFNQRNNSNNINSENQQH

SEQ ID NO: 3400936 - protein, 7 aa, Plasmodium falciparum
NFSSDKE

SEQ ID NO: 3400937 - protein, 10 aa, Plasmodium falciparum
NFSSKNDGGV

SEQ ID NO: 3400938 - protein, 6 aa, Plasmodium falciparum
NFTETS

SEQ ID NO: 3400939 - protein, 7 aa, Plasmodium falciparum
NGDSIKR

SEQ ID NO: 3400940 - protein, 5 aa, Plasmodium falciparum
NGETI

SEQ ID NO: 3400941 - protein, 6 aa, Plasmodium falciparum
NGETKN

SEQ ID NO: 3400942 - protein, 73 aa, Plasmodium falciparum
NGGDDDDDDDDDDDDDESIDTTNNDNDDNDDDDDDDDDDDDDDDDDDDDDEDEINKRKPGNKKKKPRKKKPIH

SEQ ID NO: 3400943 - protein, 12 aa, Plasmodium falciparum
NGGIENLASSSG

SEQ ID NO: 3400944 - protein, 5 aa, Plasmodium falciparum
NGIGK

SEQ ID NO: 3400945 - protein, 23 aa, Plasmodium falciparum
NGINTKSKQDENVYEKKDKVEEI

SEQ ID NO: 3400946 - protein, 29 aa, Plasmodium falciparum
NGISGGENSMSDDKTEELHDETEELYDET

SEQ ID NO: 3400947 - protein, 22 aa, Plasmodium falciparum
NGKCGPVSDEDSLDSNGDTDCY

SEQ ID NO: 3400948 - protein, 7 aa, Plasmodium falciparum
NGKEEFF

SEQ ID NO: 3400949 - protein, 4 aa, Plasmodium falciparum
NGKF

SEQ ID NO: 3400950 - protein, 6 aa, Plasmodium falciparum
NGKNNW

SEQ ID NO: 3400951 - protein, 7 aa, Plasmodium falciparum
NGKRNKE

SEQ ID NO: 3400952 - protein, 10 aa, Plasmodium falciparum
NGLNNKDNSF

SEQ ID NO: 3400953 - protein, 6 aa, Plasmodium falciparum
NGLSRE

SEQ ID NO: 3400954 - protein, 7 aa, Plasmodium falciparum
NGMDYNE

SEQ ID NO: 3400955 - protein, 4 aa, Plasmodium falciparum
NGNE

SEQ ID NO: 3400956 - protein, 8 aa, Plasmodium falciparum
NGNEGNIN

SEQ ID NO: 3400957 - protein, 27 aa, Plasmodium falciparum
NGNIENEQNKKYMDPTKQSNENNYEST

SEQ ID NO: 3400958 - protein, 5 aa, Plasmodium falciparum
NGNIN

SEQ ID NO: 3400959 - protein, 5 aa, Plasmodium falciparum
NGNPK

SEQ ID NO: 3400960 - protein, 7 aa, Plasmodium falciparum
NGNTIDD

SEQ ID NO: 3400961 - protein, 13 aa, Plasmodium falciparum
NGNVNDHTNGNVN

SEQ ID NO: 3400962 - protein, 7 aa, Plasmodium falciparum
NGPFSVG

SEQ ID NO: 3400963 - protein, 7 aa, Plasmodium falciparum
NGQDGNI

SEQ ID NO: 3400964 - protein, 7 aa, Plasmodium falciparum
NGQDNNL

SEQ ID NO: 3400965 - protein, 13 aa, Plasmodium falciparum
NGQESEEKLKDTY

SEQ ID NO: 3400966 - protein, 17 aa, Plasmodium falciparum
NGRGSNRNNKKRSISSV

SEQ ID NO: 3400967 - protein, 8 aa, Plasmodium falciparum
NGSITDQS

SEQ ID NO: 3400968 - protein, 6 aa, Plasmodium falciparum
NGSTGY

SEQ ID NO: 3400969 - protein, 5 aa, Plasmodium falciparum
NGTCR

SEQ ID NO: 3400970 - protein, 10 aa, Plasmodium falciparum
NGTKKKKQNK

SEQ ID NO: 3400971 - protein, 5 aa, Plasmodium falciparum
NGTSM

SEQ ID NO: 3400972 - protein, 11 aa, Plasmodium falciparum
NGYLSTSKSYE

SEQ ID NO: 3400973 - protein, 6 aa, Plasmodium falciparum
NHGREG

SEQ ID NO: 3400974 - protein, 6 aa, Plasmodium falciparum
NHGSLS

SEQ ID NO: 3400975 - protein, 15 aa, Plasmodium falciparum
NHHNYSDNNISTHEK

SEQ ID NO: 3400976 - protein, 11 aa, Plasmodium falciparum
NHISSEKCRDI

SEQ ID NO: 3400977 - protein, 13 aa, Plasmodium falciparum
NHISSSNDPPNDN

SEQ ID NO: 3400978 - protein, 14 aa, Plasmodium falciparum
NHKKTEKNKKYDMK

SEQ ID NO: 3400979 - protein, 16 aa, Plasmodium falciparum
NHKLSSLTNDRRSYNK

SEQ ID NO: 3400980 - protein, 12 aa, Plasmodium falciparum
NHNDKNNVDNIN

SEQ ID NO: 3400981 - protein, 5 aa, Plasmodium falciparum
NHNEY

SEQ ID NO: 3400982 - protein, 6 aa, Plasmodium falciparum
NHNGDK

SEQ ID NO: 3400983 - protein, 7 aa, Plasmodium falciparum
NHVPPQT

SEQ ID NO: 3400984 - protein, 6 aa, Plasmodium falciparum
NHYENK

SEQ ID NO: 3400985 - protein, 9 aa, Plasmodium falciparum
NIAKSYGHN

SEQ ID NO: 3400986 - protein, 9 aa, Plasmodium falciparum
NIDDKESLK

SEQ ID NO: 3400987 - protein, 10 aa, Plasmodium falciparum
NIDESSSLIP

SEQ ID NO: 3400988 - protein, 5 aa, Plasmodium falciparum
NIDLR

SEQ ID NO: 3400989 - protein, 13 aa, Plasmodium falciparum
NIGSSLNPDDIDN

SEQ ID NO: 3400990 - protein, 4 aa, Plasmodium falciparum
NIKN

SEQ ID NO: 3400991 - protein, 10 aa, Plasmodium falciparum
NIKPKTNKSI

SEQ ID NO: 3400992 - protein, 5 aa, Plasmodium falciparum
NIKRD

SEQ ID NO: 3400993 - protein, 6 aa, Plasmodium falciparum
NIKTED

SEQ ID NO: 3400994 - protein, 5 aa, Plasmodium falciparum
NIKTP

SEQ ID NO: 3400995 - protein, 24 aa, Plasmodium falciparum
NINESDNNIRDKEEDDAEKMIFDD

SEQ ID NO: 3400996 - protein, 47 aa, Plasmodium falciparum
NINNNDDKNNNSDKNNNSDKNNNSDKSYNDDKSNNDDKNNNGDNNNI

SEQ ID NO: 3400997 - protein, 7 aa, Plasmodium falciparum
NINNNEF

SEQ ID NO: 3400998 - protein, 13 aa, Plasmodium falciparum
NINNNNNNNNINN

SEQ ID NO: 3400999 - protein, 17 aa, Plasmodium falciparum
NINNTTCSKNLNANKVP

SEQ ID NO: 3401000 - protein, 5 aa, Plasmodium falciparum
NINPE

SEQ ID NO: 3401001 - protein, 31 aa, Plasmodium falciparum
NINPEKIRKDHEQNIQYSKNDPITDIQNSTN

SEQ ID NO: 3401002 - protein, 4 aa, Plasmodium falciparum
NINT

SEQ ID NO: 3401003 - protein, 7 aa, Plasmodium falciparum
NINTEED

SEQ ID NO: 3401004 - protein, 6 aa, Plasmodium falciparum
NIPTHE

SEQ ID NO: 3401005 - protein, 40 aa, Plasmodium falciparum
NIQTGRETNIRPHNNTNDHNNNTKDYNNNTNDEQNKQQSL

SEQ ID NO: 3401006 - protein, 5 aa, Plasmodium falciparum
NIRHS

SEQ ID NO: 3401007 - protein, 44 aa, Plasmodium falciparum
NISEGDGEVDGDGEGDGDGDGEGADDSSVDTHNNKNDGKESESD

SEQ ID NO: 3401008 - protein, 9 aa, Plasmodium falciparum
NISGGEDTF

SEQ ID NO: 3401009 - protein, 13 aa, Plasmodium falciparum
NISNEDEEDIARD

SEQ ID NO: 3401010 - protein, 46 aa, Plasmodium falciparum
NISNESNISNESSITNQSNLSSETNISSETNISNESSVPNESSVNE

SEQ ID NO: 3401011 - protein, 12 aa, Plasmodium falciparum
NITKNSSSNSYS

SEQ ID NO: 3401012 - protein, 16 aa, Plasmodium falciparum
NITNNEKHKNEKNISR

SEQ ID NO: 3401013 - protein, 10 aa, Plasmodium falciparum
NITSDKNSHL

SEQ ID NO: 3401014 - protein, 9 aa, Plasmodium falciparum
NKCNKDSNK

SEQ ID NO: 3401015 - protein, 16 aa, Plasmodium falciparum
NKDEKEEEDFKTAQGI

SEQ ID NO: 3401016 - protein, 7 aa, Plasmodium falciparum
NKDGKIS

SEQ ID NO: 3401017 - protein, 9 aa, Plasmodium falciparum
NKDKIKDKN

SEQ ID NO: 3401018 - protein, 7 aa, Plasmodium falciparum
NKDKNGS

SEQ ID NO: 3401019 - protein, 9 aa, Plasmodium falciparum
NKDNINNDN

SEQ ID NO: 3401020 - protein, 5 aa, Plasmodium falciparum
NKDNN

SEQ ID NO: 3401021 - protein, 7 aa, Plasmodium falciparum
NKDPNNF

SEQ ID NO: 3401022 - protein, 9 aa, Plasmodium falciparum
NKEDTEPSY

SEQ ID NO: 3401023 - protein, 7 aa, Plasmodium falciparum
NKEKEQL

SEQ ID NO: 3401024 - protein, 9 aa, Plasmodium falciparum
NKEKHTKKR

SEQ ID NO: 3401025 - protein, 5 aa, Plasmodium falciparum
NKEKN

SEQ ID NO: 3401026 - protein, 20 aa, Plasmodium falciparum
NKEKNNKIEMKDSKKGNYNK

SEQ ID NO: 3401027 - protein, 5 aa, Plasmodium falciparum
NKENI

SEQ ID NO: 3401028 - protein, 8 aa, Plasmodium falciparum
NKENKSLG

SEQ ID NO: 3401029 - protein, 6 aa, Plasmodium falciparum
NKENSL

SEQ ID NO: 3401030 - protein, 7 aa, Plasmodium falciparum
NKEPPIE

SEQ ID NO: 3401031 - protein, 9 aa, Plasmodium falciparum
NKEQKNEEV

SEQ ID NO: 3401032 - protein, 16 aa, Plasmodium falciparum
NKESEPEKQNNSNNNL

SEQ ID NO: 3401033 - protein, 7 aa, Plasmodium falciparum
NKFSSDP

SEQ ID NO: 3401034 - protein, 11 aa, Plasmodium falciparum
NKGDSDNPVSP

SEQ ID NO: 3401035 - protein, 4 aa, Plasmodium falciparum
NKGF

SEQ ID NO: 3401036 - protein, 5 aa, Plasmodium falciparum
NKGFD

SEQ ID NO: 3401037 - protein, 9 aa, Plasmodium falciparum
NKGKATYTN

SEQ ID NO: 3401038 - protein, 10 aa, Plasmodium falciparum
NKGKKKSLDT

SEQ ID NO: 3401039 - protein, 6 aa, Plasmodium falciparum
NKGTKS

SEQ ID NO: 3401040 - protein, 25 aa, Plasmodium falciparum
NKHNNDKNTSSYEKEMDNNNKSNKI

SEQ ID NO: 3401041 - protein, 10 aa, Plasmodium falciparum
NKIANKSKEK

SEQ ID NO: 3401042 - protein, 12 aa, Plasmodium falciparum
NKIGGSSGILGE

SEQ ID NO: 3401043 - protein, 4 aa, Plasmodium falciparum
NKII

SEQ ID NO: 3401044 - protein, 4 aa, Plasmodium falciparum
NKIQ

SEQ ID NO: 3401045 - protein, 6 aa, Plasmodium falciparum
NKISGN

SEQ ID NO: 3401046 - protein, 13 aa, Plasmodium falciparum
NKITDGKNKEYNN

SEQ ID NO: 3401047 - protein, 9 aa, Plasmodium falciparum
NKKADEIEK

SEQ ID NO: 3401048 - protein, 13 aa, Plasmodium falciparum
NKKDGHDNHHDQH

SEQ ID NO: 3401049 - protein, 7 aa, Plasmodium falciparum
NKKEEEK

SEQ ID NO: 3401050 - protein, 6 aa, Plasmodium falciparum
NKKEPY

SEQ ID NO: 3401051 - protein, 8 aa, Plasmodium falciparum
NKKESEEV

SEQ ID NO: 3401052 - protein, 9 aa, Plasmodium falciparum
NKKESIKEL

SEQ ID NO: 3401053 - protein, 5 aa, Plasmodium falciparum
NKKET

SEQ ID NO: 3401054 - protein, 6 aa, Plasmodium falciparum
NKKKDI

SEQ ID NO: 3401055 - protein, 9 aa, Plasmodium falciparum
NKKKGKDVQ

SEQ ID NO: 3401056 - protein, 10 aa, Plasmodium falciparum
NKKKITDKSN

SEQ ID NO: 3401057 - protein, 7 aa, Plasmodium falciparum
NKKKKAI

SEQ ID NO: 3401058 - protein, 20 aa, Plasmodium falciparum
NKKKSRIKNNKNGKKENNID

SEQ ID NO: 3401059 - protein, 6 aa, Plasmodium falciparum
NKKKYN

SEQ ID NO: 3401060 - protein, 8 aa, Plasmodium falciparum
NKKNDPSV

SEQ ID NO: 3401061 - protein, 30 aa, Plasmodium falciparum
NKKNETDNITNKENKSDNNLKEGMEKKEIQ

SEQ ID NO: 3401062 - protein, 6 aa, Plasmodium falciparum
NKKNFN

SEQ ID NO: 3401063 - protein, 9 aa, Plasmodium falciparum
NKKNKINLD

SEQ ID NO: 3401064 - protein, 8 aa, Plasmodium falciparum
NKKNNKTY

SEQ ID NO: 3401065 - protein, 6 aa, Plasmodium falciparum
NKKNNS

SEQ ID NO: 3401066 - protein, 42 aa, Plasmodium falciparum
NKKNQDSLTTTSLSTSINSVRDSSNLDQRGNITTSQGNSHRA

SEQ ID NO: 3401067 - protein, 7 aa, Plasmodium falciparum
NKKNSYL

SEQ ID NO: 3401068 - protein, 9 aa, Plasmodium falciparum
NKKQEFDDT

SEQ ID NO: 3401069 - protein, 10 aa, Plasmodium falciparum
NKKRTNAQLD

SEQ ID NO: 3401070 - protein, 11 aa, Plasmodium falciparum
NKKSCTENAPQ

SEQ ID NO: 3401071 - protein, 6 aa, Plasmodium falciparum
NKKTPT

SEQ ID NO: 3401072 - protein, 16 aa, Plasmodium falciparum
NKKVNKKKNKNNNNNI

SEQ ID NO: 3401073 - protein, 38 aa, Plasmodium falciparum
NKMNNKMNDKMNDKMNNKMNNKMNDKMNNKMNDEMDED

SEQ ID NO: 3401074 - protein, 8 aa, Plasmodium falciparum
NKNDDSYR

SEQ ID NO: 3401075 - protein, 10 aa, Plasmodium falciparum
NKNDNNIRNN

SEQ ID NO: 3401076 - protein, 8 aa, Plasmodium falciparum
NKNEEKNV

SEQ ID NO: 3401077 - protein, 5 aa, Plasmodium falciparum
NKNEK

SEQ ID NO: 3401078 - protein, 17 aa, Plasmodium falciparum
NKNEPNSLDGKGYTAYE

SEQ ID NO: 3401079 - protein, 16 aa, Plasmodium falciparum
NKNESDKKLEQSFREE

SEQ ID NO: 3401080 - protein, 6 aa, Plasmodium falciparum
NKNEYE

SEQ ID NO: 3401081 - protein, 11 aa, Plasmodium falciparum
NKNGTDDNTYV

SEQ ID NO: 3401082 - protein, 4 aa, Plasmodium falciparum
NKNI

SEQ ID NO: 3401083 - protein, 5 aa, Plasmodium falciparum
NKNII

SEQ ID NO: 3401084 - protein, 5 aa, Plasmodium falciparum
NKNIK

SEQ ID NO: 3401085 - protein, 4 aa, Plasmodium falciparum
NKNK

SEQ ID NO: 3401086 - protein, 9 aa, Plasmodium falciparum
NKNKAQDIS

SEQ ID NO: 3401087 - protein, 12 aa, Plasmodium falciparum
NKNKDVCTEGSN

SEQ ID NO: 3401088 - protein, 7 aa, Plasmodium falciparum
NKNKENY

SEQ ID NO: 3401089 - protein, 7 aa, Plasmodium falciparum
NKNKLTK

SEQ ID NO: 3401090 - protein, 5 aa, Plasmodium falciparum
NKNML

SEQ ID NO: 3401091 - protein, 21 aa, Plasmodium falciparum
NKNMSSNGEPLSEYNEQSKTN

SEQ ID NO: 3401092 - protein, 4 aa, Plasmodium falciparum
NKNN

SEQ ID NO: 3401093 - protein, 6 aa, Plasmodium falciparum
NKNNDA

SEQ ID NO: 3401094 - protein, 12 aa, Plasmodium falciparum
NKNNDVCTEGSN

SEQ ID NO: 3401095 - protein, 7 aa, Plasmodium falciparum
NKNNEKQ

SEQ ID NO: 3401096 - protein, 8 aa, Plasmodium falciparum
NKNNKKSN

SEQ ID NO: 3401097 - protein, 28 aa, Plasmodium falciparum
NKNNSETNENISESNSGNPELNNENSYS

SEQ ID NO: 3401098 - protein, 8 aa, Plasmodium falciparum
NKNPKDNK

SEQ ID NO: 3401099 - protein, 12 aa, Plasmodium falciparum
NKNPSSSLKSTF

SEQ ID NO: 3401100 - protein, 21 aa, Plasmodium falciparum
NKNQSINNNMNNENADKNVPH

SEQ ID NO: 3401101 - protein, 7 aa, Plasmodium falciparum
NKNRIKE

SEQ ID NO: 3401102 - protein, 8 aa, Plasmodium falciparum
NKNRKGKK

SEQ ID NO: 3401103 - protein, 6 aa, Plasmodium falciparum
NKNRKY

SEQ ID NO: 3401104 - protein, 7 aa, Plasmodium falciparum
NKNRNKI

SEQ ID NO: 3401105 - protein, 12 aa, Plasmodium falciparum
NKNTEEKQYEKI

SEQ ID NO: 3401106 - protein, 9 aa, Plasmodium falciparum
NKNTNKPNC

SEQ ID NO: 3401107 - protein, 8 aa, Plasmodium falciparum
NKNTREYE

SEQ ID NO: 3401108 - protein, 7 aa, Plasmodium falciparum
NKNTRND

SEQ ID NO: 3401109 - protein, 8 aa, Plasmodium falciparum
NKNTSLEV

SEQ ID NO: 3401110 - protein, 22 aa, Plasmodium falciparum
NKNTYDDNDDNSNTNDEMDDEM

SEQ ID NO: 3401111 - protein, 20 aa, Plasmodium falciparum
NKNYGEKEKKKENDTNQTDE

SEQ ID NO: 3401112 - protein, 6 aa, Plasmodium falciparum
NKNYPQ

SEQ ID NO: 3401113 - protein, 7 aa, Plasmodium falciparum
NKNYPTV

SEQ ID NO: 3401114 - protein, 7 aa, Plasmodium falciparum
NKPCPEH

SEQ ID NO: 3401115 - protein, 4 aa, Plasmodium falciparum
NKPD

SEQ ID NO: 3401116 - protein, 4 aa, Plasmodium falciparum
NKPF

SEQ ID NO: 3401117 - protein, 5 aa, Plasmodium falciparum
NKPIG

SEQ ID NO: 3401118 - protein, 7 aa, Plasmodium falciparum
NKPIKKE

SEQ ID NO: 3401119 - protein, 19 aa, Plasmodium falciparum
NKPITSKCGKNSSDDSNHD

SEQ ID NO: 3401120 - protein, 77 aa, Plasmodium falciparum
NKQKKENETEKIKGNKIECERKNRRVSEQIDDNDNNNNNNNNNNNNNNSNNNNNNNNNNNNNNNNNNNNSNNNFNSN

SEQ ID NO: 3401121 - protein, 18 aa, Plasmodium falciparum
NKQLTNNINNKKTKTDQI

SEQ ID NO: 3401122 - protein, 6 aa, Plasmodium falciparum
NKQNEK

SEQ ID NO: 3401123 - protein, 5 aa, Plasmodium falciparum
NKRNT

SEQ ID NO: 3401124 - protein, 8 aa, Plasmodium falciparum
NKRNTYNS

SEQ ID NO: 3401125 - protein, 7 aa, Plasmodium falciparum
NKRSNTK

SEQ ID NO: 3401126 - protein, 14 aa, Plasmodium falciparum
NKSARSAKMFIYKK

SEQ ID NO: 3401127 - protein, 7 aa, Plasmodium falciparum
NKSNKVQ

SEQ ID NO: 3401128 - protein, 9 aa, Plasmodium falciparum
NKSNNKTEE

SEQ ID NO: 3401129 - protein, 6 aa, Plasmodium falciparum
NKSNYI

SEQ ID NO: 3401130 - protein, 9 aa, Plasmodium falciparum
NKSSVDDGN

SEQ ID NO: 3401131 - protein, 8 aa, Plasmodium falciparum
NKSYTSQN

SEQ ID NO: 3401132 - protein, 5 aa, Plasmodium falciparum
NKTGF

SEQ ID NO: 3401133 - protein, 5 aa, Plasmodium falciparum
NKTIG

SEQ ID NO: 3401134 - protein, 14 aa, Plasmodium falciparum
NKTKKDIKKGINKG

SEQ ID NO: 3401135 - protein, 4 aa, Plasmodium falciparum
NKTN

SEQ ID NO: 3401136 - protein, 6 aa, Plasmodium falciparum
NKTNLF

SEQ ID NO: 3401137 - protein, 7 aa, Plasmodium falciparum
NKTNNTY

SEQ ID NO: 3401138 - protein, 6 aa, Plasmodium falciparum
NKTNTT

SEQ ID NO: 3401139 - protein, 7 aa, Plasmodium falciparum
NKYEKRN

SEQ ID NO: 3401140 - protein, 18 aa, Plasmodium falciparum
NKYITKQKDEENQSFTNK

SEQ ID NO: 3401141 - protein, 28 aa, Plasmodium falciparum
NKYSKELKGGKKKKKKKKKKDKKKKNHY

SEQ ID NO: 3401142 - protein, 11 aa, Plasmodium falciparum
NLENKNNSRNN

SEQ ID NO: 3401143 - protein, 9 aa, Plasmodium falciparum
NLGSGDSTM

SEQ ID NO: 3401144 - protein, 6 aa, Plasmodium falciparum
NLGTGT

SEQ ID NO: 3401145 - protein, 7 aa, Plasmodium falciparum
NLKKNAR

SEQ ID NO: 3401146 - protein, 50 aa, Plasmodium falciparum
NLKREDMETENEQNEAQPNNEKNEAQPNNEKNKAPPNDEKNEAPSNEENV

SEQ ID NO: 3401147 - protein, 5 aa, Plasmodium falciparum
NLLPD

SEQ ID NO: 3401148 - protein, 7 aa, Plasmodium falciparum
NLNKYNN

SEQ ID NO: 3401149 - protein, 11 aa, Plasmodium falciparum
NLNNDKNSNVN

SEQ ID NO: 3401150 - protein, 5 aa, Plasmodium falciparum
NLSIN

SEQ ID NO: 3401151 - protein, 8 aa, Plasmodium falciparum
NLSRTDEV

SEQ ID NO: 3401152 - protein, 10 aa, Plasmodium falciparum
NLYDQKKKYR

SEQ ID NO: 3401153 - protein, 7 aa, Plasmodium falciparum
NMSGKTT

SEQ ID NO: 3401154 - protein, 7 aa, Plasmodium falciparum
NNAMEKA

SEQ ID NO: 3401155 - protein, 63 aa, Plasmodium falciparum
NNANIQNNANIQNNANIQSNANIQNNANIQSNANIQSNANIQSNANIQSNVNSHGGTNRQNNI

SEQ ID NO: 3401156 - protein, 12 aa, Plasmodium falciparum
NNDAYGNDSGST

SEQ ID NO: 3401157 - protein, 5 aa, Plasmodium falciparum
NNDIA

SEQ ID NO: 3401158 - protein, 10 aa, Plasmodium falciparum
NNDKEITEEE

SEQ ID NO: 3401159 - protein, 9 aa, Plasmodium falciparum
NNDKENTAS

SEQ ID NO: 3401160 - protein, 7 aa, Plasmodium falciparum
NNDNDYF

SEQ ID NO: 3401161 - protein, 6 aa, Plasmodium falciparum
NNDNQK

SEQ ID NO: 3401162 - protein, 4 aa, Plasmodium falciparum
NNDQ

SEQ ID NO: 3401163 - protein, 4 aa, Plasmodium falciparum
NNED

SEQ ID NO: 3401164 - protein, 55 aa, Plasmodium falciparum
NNEDDSSNDNINGNKYYNNRKQNDNDNNKGDYNNKGDYNNKRNYSKDNDKDEYNK

SEQ ID NO: 3401165 - protein, 12 aa, Plasmodium falciparum
NNEEDNASLDDI

SEQ ID NO: 3401166 - protein, 7 aa, Plasmodium falciparum
NNEEDNN

SEQ ID NO: 3401167 - protein, 7 aa, Plasmodium falciparum
NNEEKQN

SEQ ID NO: 3401168 - protein, 10 aa, Plasmodium falciparum
NNEINNSEGM

SEQ ID NO: 3401169 - protein, 7 aa, Plasmodium falciparum
NNEKDQS

SEQ ID NO: 3401170 - protein, 8 aa, Plasmodium falciparum
NNENNKKG

SEQ ID NO: 3401171 - protein, 5 aa, Plasmodium falciparum
NNEVH

SEQ ID NO: 3401172 - protein, 7 aa, Plasmodium falciparum
NNGENDY

SEQ ID NO: 3401173 - protein, 7 aa, Plasmodium falciparum
NNGGCDK

SEQ ID NO: 3401174 - protein, 12 aa, Plasmodium falciparum
NNGHNSSSSLYN

SEQ ID NO: 3401175 - protein, 4 aa, Plasmodium falciparum
NNGN

SEQ ID NO: 3401176 - protein, 6 aa, Plasmodium falciparum
NNGNKS

SEQ ID NO: 3401177 - protein, 32 aa, Plasmodium falciparum
NNGSIRKRNNNNNSSSSNNNNNNNNNNKNNNF

SEQ ID NO: 3401178 - protein, 29 aa, Plasmodium falciparum
NNGTNKNLASQSGNNKKKKKKIATSTTNM

SEQ ID NO: 3401179 - protein, 83 aa, Plasmodium falciparum
NNGTTSNTIENNKDSNKEAENSNTEQNDNNNNDNNNNINNNNNNNDNKEEDMNENNNNSKVTGDSVENINEQTNNNQYPNTEY

SEQ ID NO: 3401180 - protein, 6 aa, Plasmodium falciparum
NNHDNA

SEQ ID NO: 3401181 - protein, 7 aa, Plasmodium falciparum
NNHPHND

SEQ ID NO: 3401182 - protein, 9 aa, Plasmodium falciparum
NNIEDNQNV

SEQ ID NO: 3401183 - protein, 10 aa, Plasmodium falciparum
NNIEKKQDNY

SEQ ID NO: 3401184 - protein, 10 aa, Plasmodium falciparum
NNIESKRTNI

SEQ ID NO: 3401185 - protein, 9 aa, Plasmodium falciparum
NNIKDDEDK

SEQ ID NO: 3401186 - protein, 6 aa, Plasmodium falciparum
NNINES

SEQ ID NO: 3401187 - protein, 24 aa, Plasmodium falciparum
NNINNNNINNNNINNNNINNNNIN

SEQ ID NO: 3401188 - protein, 4 aa, Plasmodium falciparum
NNIS

SEQ ID NO: 3401189 - protein, 7 aa, Plasmodium falciparum
NNISKEE

SEQ ID NO: 3401190 - protein, 9 aa, Plasmodium falciparum
NNKDEEGTK

SEQ ID NO: 3401191 - protein, 9 aa, Plasmodium falciparum
NNKENKIEL

SEQ ID NO: 3401192 - protein, 8 aa, Plasmodium falciparum
NNKGEGNI

SEQ ID NO: 3401193 - protein, 4 aa, Plasmodium falciparum
NNKI

SEQ ID NO: 3401194 - protein, 5 aa, Plasmodium falciparum
NNKIE

SEQ ID NO: 3401195 - protein, 4 aa, Plasmodium falciparum
NNKK

SEQ ID NO: 3401196 - protein, 10 aa, Plasmodium falciparum
NNKKKKKNLY

SEQ ID NO: 3401197 - protein, 6 aa, Plasmodium falciparum
NNKKSE

SEQ ID NO: 3401198 - protein, 4 aa, Plasmodium falciparum
NNKN

SEQ ID NO: 3401199 - protein, 5 aa, Plasmodium falciparum
NNKND

SEQ ID NO: 3401200 - protein, 7 aa, Plasmodium falciparum
NNKNDDL

SEQ ID NO: 3401201 - protein, 7 aa, Plasmodium falciparum
NNKNDNI

SEQ ID NO: 3401202 - protein, 11 aa, Plasmodium falciparum
NNKNNSDDENN

SEQ ID NO: 3401203 - protein, 10 aa, Plasmodium falciparum
NNKNSNKIKG

SEQ ID NO: 3401204 - protein, 7 aa, Plasmodium falciparum
NNKSFQK

SEQ ID NO: 3401205 - protein, 7 aa, Plasmodium falciparum
NNKSISS

SEQ ID NO: 3401206 - protein, 9 aa, Plasmodium falciparum
NNKSNKTHL

SEQ ID NO: 3401207 - protein, 4 aa, Plasmodium falciparum
NNKT

SEQ ID NO: 3401208 - protein, 10 aa, Plasmodium falciparum
NNKTTKKESK

SEQ ID NO: 3401209 - protein, 9 aa, Plasmodium falciparum
NNKTTYEFD

SEQ ID NO: 3401210 - protein, 5 aa, Plasmodium falciparum
NNLIP

SEQ ID NO: 3401211 - protein, 5 aa, Plasmodium falciparum
NNMPE

SEQ ID NO: 3401212 - protein, 6 aa, Plasmodium falciparum
NNMSTY

SEQ ID NO: 3401213 - protein, 6 aa, Plasmodium falciparum
NNNAQG

SEQ ID NO: 3401214 - protein, 9 aa, Plasmodium falciparum
NNNDDEPME

SEQ ID NO: 3401215 - protein, 9 aa, Plasmodium falciparum
NNNDEKSKI

SEQ ID NO: 3401216 - protein, 15 aa, Plasmodium falciparum
NNNDKDKNNNERNNN

SEQ ID NO: 3401217 - protein, 6 aa, Plasmodium falciparum
NNNDKY

SEQ ID NO: 3401218 - protein, 16 aa, Plasmodium falciparum
NNNDSLTSADQKNNNM

SEQ ID NO: 3401219 - protein, 4 aa, Plasmodium falciparum
NNNE

SEQ ID NO: 3401220 - protein, 8 aa, Plasmodium falciparum
NNNEKEKA

SEQ ID NO: 3401221 - protein, 8 aa, Plasmodium falciparum
NNNINNGN

SEQ ID NO: 3401222 - protein, 7 aa, Plasmodium falciparum
NNNKECE

SEQ ID NO: 3401223 - protein, 7 aa, Plasmodium falciparum
NNNKKNK

SEQ ID NO: 3401224 - protein, 8 aa, Plasmodium falciparum
NNNKLENN

SEQ ID NO: 3401225 - protein, 19 aa, Plasmodium falciparum
NNNKNNNNNNNNSHNNNHS

SEQ ID NO: 3401226 - protein, 9 aa, Plasmodium falciparum
NNNKNVTLK

SEQ ID NO: 3401227 - protein, 9 aa, Plasmodium falciparum
NNNKQNIQK

SEQ ID NO: 3401228 - protein, 4 aa, Plasmodium falciparum
NNNM

SEQ ID NO: 3401229 - protein, 14 aa, Plasmodium falciparum
NNNNDNNNNNNDNN

SEQ ID NO: 3401230 - protein, 5 aa, Plasmodium falciparum
NNNNE

SEQ ID NO: 3401231 - protein, 19 aa, Plasmodium falciparum
NNNNKKKNRNRNKNKNKIK

SEQ ID NO: 3401232 - protein, 22 aa, Plasmodium falciparum
NNNNMKKKTTLKLSEPSEEVNM

SEQ ID NO: 3401233 - protein, 12 aa, Plasmodium falciparum
NNNNMNKEPQTL

SEQ ID NO: 3401234 - protein, 5 aa, Plasmodium falciparum
NNNNN

SEQ ID NO: 3401235 - protein, 29 aa, Plasmodium falciparum
NNNNNNDGDGDYSSESFDQQNSSDDNQND

SEQ ID NO: 3401236 - protein, 22 aa, Plasmodium falciparum
NNNNNNHNNNNNYEGDPQNWKE

SEQ ID NO: 3401237 - protein, 7 aa, Plasmodium falciparum
NNNNNNI

SEQ ID NO: 3401238 - protein, 7 aa, Plasmodium falciparum
NNNNNNN

SEQ ID NO: 3401239 - protein, 9 aa, Plasmodium falciparum
NNNNNNNNI

SEQ ID NO: 3401240 - protein, 12 aa, Plasmodium falciparum
NNNNNNNNKAKS

SEQ ID NO: 3401241 - protein, 9 aa, Plasmodium falciparum
NNNNNNNNN

SEQ ID NO: 3401242 - protein, 10 aa, Plasmodium falciparum
NNNNNNNNNI

SEQ ID NO: 3401243 - protein, 10 aa, Plasmodium falciparum
NNNNNNNNNN

SEQ ID NO: 3401244 - protein, 12 aa, Plasmodium falciparum
NNNNNNNNNTLY

SEQ ID NO: 3401245 - protein, 15 aa, Plasmodium falciparum
NNNNNNNNVDDINKK

SEQ ID NO: 3401246 - protein, 15 aa, Plasmodium falciparum
NNNNNNNNYNSYSNN

SEQ ID NO: 3401247 - protein, 53 aa, Plasmodium falciparum
NNNNNVENKKEEENHNNDKKTDEQNHVNEKKQEGENNKHKKDDTIPPEKKINK

SEQ ID NO: 3401248 - protein, 13 aa, Plasmodium falciparum
NNNNTNNIYNNDT

SEQ ID NO: 3401249 - protein, 5 aa, Plasmodium falciparum
NNNRN

SEQ ID NO: 3401250 - protein, 5 aa, Plasmodium falciparum
NNNSN

SEQ ID NO: 3401251 - protein, 9 aa, Plasmodium falciparum
NNNSNINGY

SEQ ID NO: 3401252 - protein, 8 aa, Plasmodium falciparum
NNNSNSIN

SEQ ID NO: 3401253 - protein, 6 aa, Plasmodium falciparum
NNNSTG

SEQ ID NO: 3401254 - protein, 4 aa, Plasmodium falciparum
NNNT

SEQ ID NO: 3401255 - protein, 5 aa, Plasmodium falciparum
NNNTI

SEQ ID NO: 3401256 - protein, 16 aa, Plasmodium falciparum
NNNTNHGKNNKTFNND

SEQ ID NO: 3401257 - protein, 5 aa, Plasmodium falciparum
NNNVQ

SEQ ID NO: 3401258 - protein, 4 aa, Plasmodium falciparum
NNNY

SEQ ID NO: 3401259 - protein, 9 aa, Plasmodium falciparum
NNNYEDDEK

SEQ ID NO: 3401260 - protein, 10 aa, Plasmodium falciparum
NNNYKNNKIN

SEQ ID NO: 3401261 - protein, 10 aa, Plasmodium falciparum
NNPDNKTCSA

SEQ ID NO: 3401262 - protein, 10 aa, Plasmodium falciparum
NNPKAQTGGN

SEQ ID NO: 3401263 - protein, 5 aa, Plasmodium falciparum
NNPPK

SEQ ID NO: 3401264 - protein, 21 aa, Plasmodium falciparum
NNPQEPSPNPEEGKGENPNGF

SEQ ID NO: 3401265 - protein, 6 aa, Plasmodium falciparum
NNQIDS

SEQ ID NO: 3401266 - protein, 5 aa, Plasmodium falciparum
NNQNN

SEQ ID NO: 3401267 - protein, 4 aa, Plasmodium falciparum
NNQR

SEQ ID NO: 3401268 - protein, 6 aa, Plasmodium falciparum
NNQRNI

SEQ ID NO: 3401269 - protein, 8 aa, Plasmodium falciparum
NNRNNDID

SEQ ID NO: 3401270 - protein, 13 aa, Plasmodium falciparum
NNRSIYRKEYITN

SEQ ID NO: 3401271 - protein, 8 aa, Plasmodium falciparum
NNRTNNSA

SEQ ID NO: 3401272 - protein, 8 aa, Plasmodium falciparum
NNRYNKTE

SEQ ID NO: 3401273 - protein, 7 aa, Plasmodium falciparum
NNSEDDD

SEQ ID NO: 3401274 - protein, 6 aa, Plasmodium falciparum
NNSEFN

SEQ ID NO: 3401275 - protein, 9 aa, Plasmodium falciparum
NNSMNGSSN

SEQ ID NO: 3401276 - protein, 11 aa, Plasmodium falciparum
NNSNADSEALK

SEQ ID NO: 3401277 - protein, 8 aa, Plasmodium falciparum
NNSNKRRR

SEQ ID NO: 3401278 - protein, 9 aa, Plasmodium falciparum
NNSSDESNI

SEQ ID NO: 3401279 - protein, 31 aa, Plasmodium falciparum
NNSSNRDTNKYTDNDYNNNNNNNNNNKDGDK

SEQ ID NO: 3401280 - protein, 11 aa, Plasmodium falciparum
NNSSSDNNIST

SEQ ID NO: 3401281 - protein, 7 aa, Plasmodium falciparum
NNSSYAR

SEQ ID NO: 3401282 - protein, 12 aa, Plasmodium falciparum
NNSTNNDTYNNS

SEQ ID NO: 3401283 - protein, 4 aa, Plasmodium falciparum
NNSV

SEQ ID NO: 3401284 - protein, 13 aa, Plasmodium falciparum
NNTHCNNDPESKE

SEQ ID NO: 3401285 - protein, 7 aa, Plasmodium falciparum
NNTHNNN

SEQ ID NO: 3401286 - protein, 4 aa, Plasmodium falciparum
NNTM

SEQ ID NO: 3401287 - protein, 8 aa, Plasmodium falciparum
NNTNEFNK

SEQ ID NO: 3401288 - protein, 8 aa, Plasmodium falciparum
NNTNETVP

SEQ ID NO: 3401289 - protein, 8 aa, Plasmodium falciparum
NNTNKPGY

SEQ ID NO: 3401290 - protein, 15 aa, Plasmodium falciparum
NNTNYNEVTEETKEE

SEQ ID NO: 3401291 - protein, 5 aa, Plasmodium falciparum
NNTSN

SEQ ID NO: 3401292 - protein, 4 aa, Plasmodium falciparum
NNTY

SEQ ID NO: 3401293 - protein, 4 aa, Plasmodium falciparum
NNVK

SEQ ID NO: 3401294 - protein, 5 aa, Plasmodium falciparum
NNVRD

SEQ ID NO: 3401295 - protein, 23 aa, Plasmodium falciparum
NNVSEYDDASDDDENSESSDESF

SEQ ID NO: 3401296 - protein, 11 aa, Plasmodium falciparum
NNYAPKIKNDE

SEQ ID NO: 3401297 - protein, 6 aa, Plasmodium falciparum
NNYEQN

SEQ ID NO: 3401298 - protein, 7 aa, Plasmodium falciparum
NNYNKEG

SEQ ID NO: 3401299 - protein, 27 aa, Plasmodium falciparum
NNYNNVTGQNVDDYDKNGDNNNHNDLE

SEQ ID NO: 3401300 - protein, 33 aa, Plasmodium falciparum
NNYTRNGSSSSSNNNNNNNNNIGNNGKITYNEN

SEQ ID NO: 3401301 - protein, 8 aa, Plasmodium falciparum
NNYYTPDS

SEQ ID NO: 3401302 - protein, 9 aa, Plasmodium falciparum
NPDESKKRR

SEQ ID NO: 3401303 - protein, 14 aa, Plasmodium falciparum
NPEFEGQTKTKLGS

SEQ ID NO: 3401304 - protein, 6 aa, Plasmodium falciparum
NPEFSE

SEQ ID NO: 3401305 - protein, 5 aa, Plasmodium falciparum
NPENY

SEQ ID NO: 3401306 - protein, 9 aa, Plasmodium falciparum
NPERHKPNN

SEQ ID NO: 3401307 - protein, 5 aa, Plasmodium falciparum
NPFIT

SEQ ID NO: 3401308 - protein, 43 aa, Plasmodium falciparum
NPFQEEKKDDESFYTSEDEDTLDHSHEKEDDVSHPEHEDHNEG

SEQ ID NO: 3401309 - protein, 20 aa, Plasmodium falciparum
NPGRQGNENFSEKNSSDEYE

SEQ ID NO: 3401310 - protein, 10 aa, Plasmodium falciparum
NPIPSNESQP

SEQ ID NO: 3401311 - protein, 6 aa, Plasmodium falciparum
NPKITK

SEQ ID NO: 3401312 - protein, 6 aa, Plasmodium falciparum
NPKKVV

SEQ ID NO: 3401313 - protein, 18 aa, Plasmodium falciparum
NPKNTSFTSTKNKNNYIQ

SEQ ID NO: 3401314 - protein, 6 aa, Plasmodium falciparum
NPNEPN

SEQ ID NO: 3401315 - protein, 8 aa, Plasmodium falciparum
NPPKSPDH

SEQ ID NO: 3401316 - protein, 6 aa, Plasmodium falciparum
NPQSNV

SEQ ID NO: 3401317 - protein, 5 aa, Plasmodium falciparum
NPRDS

SEQ ID NO: 3401318 - protein, 4 aa, Plasmodium falciparum
NPRF

SEQ ID NO: 3401319 - protein, 4 aa, Plasmodium falciparum
NPRK

SEQ ID NO: 3401320 - protein, 4 aa, Plasmodium falciparum
NPSI

SEQ ID NO: 3401321 - protein, 4 aa, Plasmodium falciparum
NPSM

SEQ ID NO: 3401322 - protein, 7 aa, Plasmodium falciparum
NPSQPLE

SEQ ID NO: 3401323 - protein, 10 aa, Plasmodium falciparum
NPTKEVTSEE

SEQ ID NO: 3401324 - protein, 4 aa, Plasmodium falciparum
NPTT

SEQ ID NO: 3401325 - protein, 10 aa, Plasmodium falciparum
NPTTNKEKIR

SEQ ID NO: 3401326 - protein, 4 aa, Plasmodium falciparum
NPWG

SEQ ID NO: 3401327 - protein, 12 aa, Plasmodium falciparum
NPYSENTPNNNI

SEQ ID NO: 3401328 - protein, 10 aa, Plasmodium falciparum
NQEESGTNKK

SEQ ID NO: 3401329 - protein, 13 aa, Plasmodium falciparum
NQEKESDKKKSQY

SEQ ID NO: 3401330 - protein, 16 aa, Plasmodium falciparum
NQESNKINDKSKLPNI

SEQ ID NO: 3401331 - protein, 10 aa, Plasmodium falciparum
NQESVKKEPK

SEQ ID NO: 3401332 - protein, 9 aa, Plasmodium falciparum
NQETEEEME

SEQ ID NO: 3401333 - protein, 4 aa, Plasmodium falciparum
NQFE

SEQ ID NO: 3401334 - protein, 6 aa, Plasmodium falciparum
NQGCDG

SEQ ID NO: 3401335 - protein, 7 aa, Plasmodium falciparum
NQGKPNI

SEQ ID NO: 3401336 - protein, 9 aa, Plasmodium falciparum
NQINENDNN

SEQ ID NO: 3401337 - protein, 4 aa, Plasmodium falciparum
NQIY

SEQ ID NO: 3401338 - protein, 4 aa, Plasmodium falciparum
NQKC

SEQ ID NO: 3401339 - protein, 10 aa, Plasmodium falciparum
NQKEHIDQSQ

SEQ ID NO: 3401340 - protein, 10 aa, Plasmodium falciparum
NQKSKYSATK

SEQ ID NO: 3401341 - protein, 8 aa, Plasmodium falciparum
NQLDPSLK

SEQ ID NO: 3401342 - protein, 5 aa, Plasmodium falciparum
NQLGS

SEQ ID NO: 3401343 - protein, 9 aa, Plasmodium falciparum
NQNKTDSYL

SEQ ID NO: 3401344 - protein, 5 aa, Plasmodium falciparum
NQNNY

SEQ ID NO: 3401345 - protein, 16 aa, Plasmodium falciparum
NQNSHSEDRKRKNFQR

SEQ ID NO: 3401346 - protein, 17 aa, Plasmodium falciparum
NQPNDYSSGDIPFNTQP

SEQ ID NO: 3401347 - protein, 13 aa, Plasmodium falciparum
NQQFSTQQYGNNM

SEQ ID NO: 3401348 - protein, 5 aa, Plasmodium falciparum
NQSYI

SEQ ID NO: 3401349 - protein, 10 aa, Plasmodium falciparum
NRDEKKRKNL

SEQ ID NO: 3401350 - protein, 9 aa, Plasmodium falciparum
NRDTHKQND

SEQ ID NO: 3401351 - protein, 10 aa, Plasmodium falciparum
NREKEISNTK

SEQ ID NO: 3401352 - protein, 6 aa, Plasmodium falciparum
NRFTGR

SEQ ID NO: 3401353 - protein, 9 aa, Plasmodium falciparum
NRGRNGRYY

SEQ ID NO: 3401354 - protein, 4 aa, Plasmodium falciparum
NRIT

SEQ ID NO: 3401355 - protein, 17 aa, Plasmodium falciparum
NRMEQQNNSVNVSKDNS

SEQ ID NO: 3401356 - protein, 6 aa, Plasmodium falciparum
NRNLSK

SEQ ID NO: 3401357 - protein, 4 aa, Plasmodium falciparum
NRNN

SEQ ID NO: 3401358 - protein, 12 aa, Plasmodium falciparum
NRSSIKNKGCKS

SEQ ID NO: 3401359 - protein, 8 aa, Plasmodium falciparum
NRSTYTDN

SEQ ID NO: 3401360 - protein, 6 aa, Plasmodium falciparum
NRTDEN

SEQ ID NO: 3401361 - protein, 11 aa, Plasmodium falciparum
NRTRLNSKKDF

SEQ ID NO: 3401362 - protein, 5 aa, Plasmodium falciparum
NSAFN

SEQ ID NO: 3401363 - protein, 6 aa, Plasmodium falciparum
NSATST

SEQ ID NO: 3401364 - protein, 13 aa, Plasmodium falciparum
NSCSRSTSKNAEM

SEQ ID NO: 3401365 - protein, 5 aa, Plasmodium falciparum
NSDEV

SEQ ID NO: 3401366 - protein, 11 aa, Plasmodium falciparum
NSDNEGENKDY

SEQ ID NO: 3401367 - protein, 7 aa, Plasmodium falciparum
NSDNIGG

SEQ ID NO: 3401368 - protein, 6 aa, Plasmodium falciparum
NSDNLK

SEQ ID NO: 3401369 - protein, 19 aa, Plasmodium falciparum
NSDTNGKNENNESNDEEYD

SEQ ID NO: 3401370 - protein, 5 aa, Plasmodium falciparum
NSEDK

SEQ ID NO: 3401371 - protein, 8 aa, Plasmodium falciparum
NSEEGKSA

SEQ ID NO: 3401372 - protein, 6 aa, Plasmodium falciparum
NSETEN

SEQ ID NO: 3401373 - protein, 7 aa, Plasmodium falciparum
NSEVAQP

SEQ ID NO: 3401374 - protein, 4 aa, Plasmodium falciparum
NSEY

SEQ ID NO: 3401375 - protein, 5 aa, Plasmodium falciparum
NSEYS

SEQ ID NO: 3401376 - protein, 21 aa, Plasmodium falciparum
NSFNEPQNDNINYNEEGENIQ

SEQ ID NO: 3401377 - protein, 15 aa, Plasmodium falciparum
NSGEKEEKKNSASQN

SEQ ID NO: 3401378 - protein, 8 aa, Plasmodium falciparum
NSGKGNFE

SEQ ID NO: 3401379 - protein, 9 aa, Plasmodium falciparum
NSGNPMDDN

SEQ ID NO: 3401380 - protein, 6 aa, Plasmodium falciparum
NSINEE

SEQ ID NO: 3401381 - protein, 4 aa, Plasmodium falciparum
NSKE

SEQ ID NO: 3401382 - protein, 8 aa, Plasmodium falciparum
NSKGGILE

SEQ ID NO: 3401383 - protein, 6 aa, Plasmodium falciparum
NSKGKY

SEQ ID NO: 3401384 - protein, 7 aa, Plasmodium falciparum
NSKHNNN

SEQ ID NO: 3401385 - protein, 7 aa, Plasmodium falciparum
NSKKKIK

SEQ ID NO: 3401386 - protein, 19 aa, Plasmodium falciparum
NSKNNNKRTSYNKKKENLK

SEQ ID NO: 3401387 - protein, 4 aa, Plasmodium falciparum
NSLN

SEQ ID NO: 3401388 - protein, 5 aa, Plasmodium falciparum
NSLNP

SEQ ID NO: 3401389 - protein, 9 aa, Plasmodium falciparum
NSNAPQFNE

SEQ ID NO: 3401390 - protein, 5 aa, Plasmodium falciparum
NSNDV

SEQ ID NO: 3401391 - protein, 11 aa, Plasmodium falciparum
NSNERENDING

SEQ ID NO: 3401392 - protein, 4 aa, Plasmodium falciparum
NSNF

SEQ ID NO: 3401393 - protein, 12 aa, Plasmodium falciparum
NSNGSNKNDVNN

SEQ ID NO: 3401394 - protein, 12 aa, Plasmodium falciparum
NSNKEEKSMNKN

SEQ ID NO: 3401395 - protein, 7 aa, Plasmodium falciparum
NSNNHSL

SEQ ID NO: 3401396 - protein, 4 aa, Plasmodium falciparum
NSNR

SEQ ID NO: 3401397 - protein, 6 aa, Plasmodium falciparum
NSNRKI

SEQ ID NO: 3401398 - protein, 11 aa, Plasmodium falciparum
NSNSPTQSSQF

SEQ ID NO: 3401399 - protein, 6 aa, Plasmodium falciparum
NSPENS

SEQ ID NO: 3401400 - protein, 15 aa, Plasmodium falciparum
NSPEQYRQKEKQQQV

SEQ ID NO: 3401401 - protein, 5 aa, Plasmodium falciparum
NSPTF

SEQ ID NO: 3401402 - protein, 9 aa, Plasmodium falciparum
NSQDGTADV

SEQ ID NO: 3401403 - protein, 5 aa, Plasmodium falciparum
NSQGC

SEQ ID NO: 3401404 - protein, 4 aa, Plasmodium falciparum
NSQI

SEQ ID NO: 3401405 - protein, 21 aa, Plasmodium falciparum
NSQIENEENVNTTITGNDFSG

SEQ ID NO: 3401406 - protein, 5 aa, Plasmodium falciparum
NSRAD

SEQ ID NO: 3401407 - protein, 4 aa, Plasmodium falciparum
NSRS

SEQ ID NO: 3401408 - protein, 9 aa, Plasmodium falciparum
NSRTNQYPH

SEQ ID NO: 3401409 - protein, 15 aa, Plasmodium falciparum
NSSEDTLKKSKNMNI

SEQ ID NO: 3401410 - protein, 6 aa, Plasmodium falciparum
NSSEEI

SEQ ID NO: 3401411 - protein, 14 aa, Plasmodium falciparum
NSSEKNIKLSNSKG

SEQ ID NO: 3401412 - protein, 5 aa, Plasmodium falciparum
NSSII

SEQ ID NO: 3401413 - protein, 5 aa, Plasmodium falciparum
NSSIK

SEQ ID NO: 3401414 - protein, 5 aa, Plasmodium falciparum
NSSNI

SEQ ID NO: 3401415 - protein, 8 aa, Plasmodium falciparum
NSSNNRND

SEQ ID NO: 3401416 - protein, 22 aa, Plasmodium falciparum
NSSQDNLDKDTISTEPFPNQKH

SEQ ID NO: 3401417 - protein, 8 aa, Plasmodium falciparum
NSSSTNED

SEQ ID NO: 3401418 - protein, 4 aa, Plasmodium falciparum
NSTC

SEQ ID NO: 3401419 - protein, 6 aa, Plasmodium falciparum
NSTCGP

SEQ ID NO: 3401420 - protein, 10 aa, Plasmodium falciparum
NSTEENNNKD

SEQ ID NO: 3401421 - protein, 5 aa, Plasmodium falciparum
NSTHE

SEQ ID NO: 3401422 - protein, 9 aa, Plasmodium falciparum
NSTKDKKNV

SEQ ID NO: 3401423 - protein, 16 aa, Plasmodium falciparum
NSTLDDDHNPDNTIDG

SEQ ID NO: 3401424 - protein, 4 aa, Plasmodium falciparum
NSYN

SEQ ID NO: 3401425 - protein, 13 aa, Plasmodium falciparum
NTASSQEQHGISE

SEQ ID NO: 3401426 - protein, 9 aa, Plasmodium falciparum
NTCEAPKNY

SEQ ID NO: 3401427 - protein, 14 aa, Plasmodium falciparum
NTDVPAGDIGVGGR

SEQ ID NO: 3401428 - protein, 4 aa, Plasmodium falciparum
NTEN

SEQ ID NO: 3401429 - protein, 11 aa, Plasmodium falciparum
NTEYKDENQYI

SEQ ID NO: 3401430 - protein, 5 aa, Plasmodium falciparum
NTGNS

SEQ ID NO: 3401431 - protein, 7 aa, Plasmodium falciparum
NTHTEED

SEQ ID NO: 3401432 - protein, 23 aa, Plasmodium falciparum
NTIDTTPINTKNHNKKKKSKYET

SEQ ID NO: 3401433 - protein, 10 aa, Plasmodium falciparum
NTIEKKTEKA

SEQ ID NO: 3401434 - protein, 5 aa, Plasmodium falciparum
NTINK

SEQ ID NO: 3401435 - protein, 6 aa, Plasmodium falciparum
NTIYKP

SEQ ID NO: 3401436 - protein, 7 aa, Plasmodium falciparum
NTKQSEC

SEQ ID NO: 3401437 - protein, 5 aa, Plasmodium falciparum
NTLEN

SEQ ID NO: 3401438 - protein, 10 aa, Plasmodium falciparum
NTLKEKKQKD

SEQ ID NO: 3401439 - protein, 4 aa, Plasmodium falciparum
NTME

SEQ ID NO: 3401440 - protein, 5 aa, Plasmodium falciparum
NTNEE

SEQ ID NO: 3401441 - protein, 10 aa, Plasmodium falciparum
NTNELKSKTD

SEQ ID NO: 3401442 - protein, 6 aa, Plasmodium falciparum
NTNEYK

SEQ ID NO: 3401443 - protein, 11 aa, Plasmodium falciparum
NTNKGYTTNKE

SEQ ID NO: 3401444 - protein, 25 aa, Plasmodium falciparum
NTNNRSNHNKHNNNKYNYNNNNCSS

SEQ ID NO: 3401445 - protein, 16 aa, Plasmodium falciparum
NTNSNEYDKNASTLDE

SEQ ID NO: 3401446 - protein, 8 aa, Plasmodium falciparum
NTNTCNKQ

SEQ ID NO: 3401447 - protein, 35 aa, Plasmodium falciparum
NTNTNTNTNTNTNTNTNTNTNTNTNKSKKRSDSNF

SEQ ID NO: 3401448 - protein, 6 aa, Plasmodium falciparum
NTPKEI

SEQ ID NO: 3401449 - protein, 6 aa, Plasmodium falciparum
NTPRIK

SEQ ID NO: 3401450 - protein, 6 aa, Plasmodium falciparum
NTPSGY

SEQ ID NO: 3401451 - protein, 13 aa, Plasmodium falciparum
NTQHKNTNNNVSV

SEQ ID NO: 3401452 - protein, 7 aa, Plasmodium falciparum
NTQKDGV

SEQ ID NO: 3401453 - protein, 6 aa, Plasmodium falciparum
NTQTHT

SEQ ID NO: 3401454 - protein, 13 aa, Plasmodium falciparum
NTRLKKQEQVPED

SEQ ID NO: 3401455 - protein, 5 aa, Plasmodium falciparum
NTSEV

SEQ ID NO: 3401456 - protein, 5 aa, Plasmodium falciparum
NTSNK

SEQ ID NO: 3401457 - protein, 7 aa, Plasmodium falciparum
NTSRKGY

SEQ ID NO: 3401458 - protein, 9 aa, Plasmodium falciparum
NTSTPSNNF

SEQ ID NO: 3401459 - protein, 8 aa, Plasmodium falciparum
NTTDGGTH

SEQ ID NO: 3401460 - protein, 9 aa, Plasmodium falciparum
NTTELGSNV

SEQ ID NO: 3401461 - protein, 6 aa, Plasmodium falciparum
NTTGES

SEQ ID NO: 3401462 - protein, 9 aa, Plasmodium falciparum
NTTNEQNNK

SEQ ID NO: 3401463 - protein, 9 aa, Plasmodium falciparum
NTTQKKTTI

SEQ ID NO: 3401464 - protein, 4 aa, Plasmodium falciparum
NTVN

SEQ ID NO: 3401465 - protein, 17 aa, Plasmodium falciparum
NTYENNTNQNKNRNSHD

SEQ ID NO: 3401466 - protein, 4 aa, Plasmodium falciparum
NTYY

SEQ ID NO: 3401467 - protein, 7 aa, Plasmodium falciparum
NVDDDGA

SEQ ID NO: 3401468 - protein, 7 aa, Plasmodium falciparum
NVEDEAI

SEQ ID NO: 3401469 - protein, 8 aa, Plasmodium falciparum
NVEDNNIE

SEQ ID NO: 3401470 - protein, 5 aa, Plasmodium falciparum
NVEEK

SEQ ID NO: 3401471 - protein, 16 aa, Plasmodium falciparum
NVENSSSTKNNGNNLS

SEQ ID NO: 3401472 - protein, 18 aa, Plasmodium falciparum
NVESFNNNKDKKIVRQES

SEQ ID NO: 3401473 - protein, 6 aa, Plasmodium falciparum
NVGTNK

SEQ ID NO: 3401474 - protein, 11 aa, Plasmodium falciparum
NVHTKNNNQYN

SEQ ID NO: 3401475 - protein, 4 aa, Plasmodium falciparum
NVKT

SEQ ID NO: 3401476 - protein, 4 aa, Plasmodium falciparum
NVNA

SEQ ID NO: 3401477 - protein, 10 aa, Plasmodium falciparum
NVNGDNNYGK

SEQ ID NO: 3401478 - protein, 39 aa, Plasmodium falciparum
NVNPGGDSVHQNEDATKTNNVTDKDNRTHIDDSNQNNNI

SEQ ID NO: 3401479 - protein, 4 aa, Plasmodium falciparum
NVNS

SEQ ID NO: 3401480 - protein, 8 aa, Plasmodium falciparum
NVNSTDKK

SEQ ID NO: 3401481 - protein, 9 aa, Plasmodium falciparum
NVNTRSKRA

SEQ ID NO: 3401482 - protein, 31 aa, Plasmodium falciparum
NVQAKENGNIKTETQKGTQKGTQKGTHNSRD

SEQ ID NO: 3401483 - protein, 12 aa, Plasmodium falciparum
NVQEPNEQTNKF

SEQ ID NO: 3401484 - protein, 9 aa, Plasmodium falciparum
NVQKTSLKK

SEQ ID NO: 3401485 - protein, 6 aa, Plasmodium falciparum
NVSNSV

SEQ ID NO: 3401486 - protein, 9 aa, Plasmodium falciparum
NVTQSKEHK

SEQ ID NO: 3401487 - protein, 6 aa, Plasmodium falciparum
NVTSSD

SEQ ID NO: 3401488 - protein, 17 aa, Plasmodium falciparum
NVYEPNDEEKQNEQKLK

SEQ ID NO: 3401489 - protein, 10 aa, Plasmodium falciparum
NYDNNTDDGV

SEQ ID NO: 3401490 - protein, 18 aa, Plasmodium falciparum
NYEDTSVNNENGDQSVDM

SEQ ID NO: 3401491 - protein, 5 aa, Plasmodium falciparum
NYESG

SEQ ID NO: 3401492 - protein, 18 aa, Plasmodium falciparum
NYETTSATNIFTKLFSML

SEQ ID NO: 3401493 - protein, 4 aa, Plasmodium falciparum
NYNE

SEQ ID NO: 3401494 - protein, 8 aa, Plasmodium falciparum
NYNEDNKK

SEQ ID NO: 3401495 - protein, 12 aa, Plasmodium falciparum
NYPNGDRGGTDI

SEQ ID NO: 3401496 - protein, 8 aa, Plasmodium falciparum
NYQMNQKK

SEQ ID NO: 3401497 - protein, 8 aa, Plasmodium falciparum
NYSDRDKK

SEQ ID NO: 3401498 - protein, 6 aa, Plasmodium falciparum
NYSEQS

SEQ ID NO: 3401499 - protein, 12 aa, Plasmodium falciparum
NYSPEDDKLKDT

SEQ ID NO: 3401500 - protein, 7 aa, Plasmodium falciparum
NYTKTEN

SEQ ID NO: 3401501 - protein, 14 aa, Plasmodium falciparum
NYTYDDDEKYDTEQ

SEQ ID NO: 3401502 - protein, 19 aa, Plasmodium falciparum
NYVNTTNNTNNTNKQEDQN

SEQ ID NO: 3401503 - protein, 7 aa, Plasmodium falciparum
PAGSQNN

SEQ ID NO: 3401504 - protein, 19 aa, Plasmodium falciparum
PCESNKKECKRTNLASSSQ

SEQ ID NO: 3401505 - protein, 11 aa, Plasmodium falciparum
PDEQSEEDNVD

SEQ ID NO: 3401506 - protein, 5 aa, Plasmodium falciparum
PDFST

SEQ ID NO: 3401507 - protein, 4 aa, Plasmodium falciparum
PDGY

SEQ ID NO: 3401508 - protein, 9 aa, Plasmodium falciparum
PDIAPDKEK

SEQ ID NO: 3401509 - protein, 10 aa, Plasmodium falciparum
PDNKQEQGKY

SEQ ID NO: 3401510 - protein, 7 aa, Plasmodium falciparum
PDNSITN

SEQ ID NO: 3401511 - protein, 7 aa, Plasmodium falciparum
PDPFRKD

SEQ ID NO: 3401512 - protein, 10 aa, Plasmodium falciparum
PDSDSYYDDE

SEQ ID NO: 3401513 - protein, 7 aa, Plasmodium falciparum
PDSPKYK

SEQ ID NO: 3401514 - protein, 4 aa, Plasmodium falciparum
PDTS

SEQ ID NO: 3401515 - protein, 11 aa, Plasmodium falciparum
PEDDKNEKGQH

SEQ ID NO: 3401516 - protein, 10 aa, Plasmodium falciparum
PEDDKNEKVE

SEQ ID NO: 3401517 - protein, 9 aa, Plasmodium falciparum
PEEDSCDKE

SEQ ID NO: 3401518 - protein, 4 aa, Plasmodium falciparum
PEFE

SEQ ID NO: 3401519 - protein, 5 aa, Plasmodium falciparum
PEIEE

SEQ ID NO: 3401520 - protein, 4 aa, Plasmodium falciparum
PEKS

SEQ ID NO: 3401521 - protein, 12 aa, Plasmodium falciparum
PENTEDAGNNNM

SEQ ID NO: 3401522 - protein, 4 aa, Plasmodium falciparum
PENV

SEQ ID NO: 3401523 - protein, 9 aa, Plasmodium falciparum
PEPNQNNEF

SEQ ID NO: 3401524 - protein, 41 aa, Plasmodium falciparum
PEQNDEESGESGLVDNEEGDFEEPNHEEFEPDQNDSELSEN

SEQ ID NO: 3401525 - protein, 7 aa, Plasmodium falciparum
PETSYNQ

SEQ ID NO: 3401526 - protein, 7 aa, Plasmodium falciparum
PFTGETT

SEQ ID NO: 3401527 - protein, 10 aa, Plasmodium falciparum
PGDKVASDYK

SEQ ID NO: 3401528 - protein, 4 aa, Plasmodium falciparum
PGGG

SEQ ID NO: 3401529 - protein, 4 aa, Plasmodium falciparum
PGIG

SEQ ID NO: 3401530 - protein, 5 aa, Plasmodium falciparum
PGNYV

SEQ ID NO: 3401531 - protein, 9 aa, Plasmodium falciparum
PGPGFNGHG

SEQ ID NO: 3401532 - protein, 5 aa, Plasmodium falciparum
PGVGK

SEQ ID NO: 3401533 - protein, 11 aa, Plasmodium falciparum
PHGGKHRSDID

SEQ ID NO: 3401534 - protein, 5 aa, Plasmodium falciparum
PHKKE

SEQ ID NO: 3401535 - protein, 8 aa, Plasmodium falciparum
PIKDVTKE

SEQ ID NO: 3401536 - protein, 5 aa, Plasmodium falciparum
PIKNS

SEQ ID NO: 3401537 - protein, 10 aa, Plasmodium falciparum
PITDDKKERW

SEQ ID NO: 3401538 - protein, 4 aa, Plasmodium falciparum
PKAN

SEQ ID NO: 3401539 - protein, 10 aa, Plasmodium falciparum
PKEEESEEIR

SEQ ID NO: 3401540 - protein, 20 aa, Plasmodium falciparum
PKEKEKEKEKVKKRRPKSMD

SEQ ID NO: 3401541 - protein, 5 aa, Plasmodium falciparum
PKESL

SEQ ID NO: 3401542 - protein, 6 aa, Plasmodium falciparum
PKFGPS

SEQ ID NO: 3401543 - protein, 13 aa, Plasmodium falciparum
PKGEMKGSAITGP

SEQ ID NO: 3401544 - protein, 9 aa, Plasmodium falciparum
PKGKTTEDN

SEQ ID NO: 3401545 - protein, 8 aa, Plasmodium falciparum
PKGNSINN

SEQ ID NO: 3401546 - protein, 6 aa, Plasmodium falciparum
PKHGEL

SEQ ID NO: 3401547 - protein, 5 aa, Plasmodium falciparum
PKIDT

SEQ ID NO: 3401548 - protein, 26 aa, Plasmodium falciparum
PKKKEDNQAVDTKSMEEPKVKAQPAL

SEQ ID NO: 3401549 - protein, 5 aa, Plasmodium falciparum
PKKNG

SEQ ID NO: 3401550 - protein, 22 aa, Plasmodium falciparum
PKKPENKHDNQNNLPNDKSDRY

SEQ ID NO: 3401551 - protein, 7 aa, Plasmodium falciparum
PKKTGKE

SEQ ID NO: 3401552 - protein, 7 aa, Plasmodium falciparum
PKLEGQK

SEQ ID NO: 3401553 - protein, 6 aa, Plasmodium falciparum
PKLSQQ

SEQ ID NO: 3401554 - protein, 11 aa, Plasmodium falciparum
PKNRKGNNNNI

SEQ ID NO: 3401555 - protein, 5 aa, Plasmodium falciparum
PKPIN

SEQ ID NO: 3401556 - protein, 4 aa, Plasmodium falciparum
PKQV

SEQ ID NO: 3401557 - protein, 6 aa, Plasmodium falciparum
PKSAEA

SEQ ID NO: 3401558 - protein, 16 aa, Plasmodium falciparum
PKSRKGDASRMAMLEL

SEQ ID NO: 3401559 - protein, 4 aa, Plasmodium falciparum
PKYD

SEQ ID NO: 3401560 - protein, 5 aa, Plasmodium falciparum
PKYKT

SEQ ID NO: 3401561 - protein, 10 aa, Plasmodium falciparum
PLAGGASSDY

SEQ ID NO: 3401562 - protein, 12 aa, Plasmodium falciparum
PLIDPSNFPTKR

SEQ ID NO: 3401563 - protein, 5 aa, Plasmodium falciparum
PLKKN

SEQ ID NO: 3401564 - protein, 9 aa, Plasmodium falciparum
PLKNGNVSE

SEQ ID NO: 3401565 - protein, 7 aa, Plasmodium falciparum
PLSPSEW

SEQ ID NO: 3401566 - protein, 4 aa, Plasmodium falciparum
PLTD

SEQ ID NO: 3401567 - protein, 20 aa, Plasmodium falciparum
PMGGGKGGSDFDPKGKSENE

SEQ ID NO: 3401568 - protein, 20 aa, Plasmodium falciparum
PMNNNNNNNNNNNKQCTNQT

SEQ ID NO: 3401569 - protein, 11 aa, Plasmodium falciparum
PNDGNKVKYND

SEQ ID NO: 3401570 - protein, 4 aa, Plasmodium falciparum
PNDP

SEQ ID NO: 3401571 - protein, 12 aa, Plasmodium falciparum
PNDRNDSNSHSY

SEQ ID NO: 3401572 - protein, 5 aa, Plasmodium falciparum
PNEEK

SEQ ID NO: 3401573 - protein, 15 aa, Plasmodium falciparum
PNGTYDDENLSDEKQ

SEQ ID NO: 3401574 - protein, 29 aa, Plasmodium falciparum
PNHEGTSAPGNSRTPSIVSPTAAEKSRKA

SEQ ID NO: 3401575 - protein, 7 aa, Plasmodium falciparum
PNMGNKN

SEQ ID NO: 3401576 - protein, 4 aa, Plasmodium falciparum
PNND

SEQ ID NO: 3401577 - protein, 7 aa, Plasmodium falciparum
PNNDPDY

SEQ ID NO: 3401578 - protein, 9 aa, Plasmodium falciparum
PNNTQQKIT

SEQ ID NO: 3401579 - protein, 4 aa, Plasmodium falciparum
PNPK

SEQ ID NO: 3401580 - protein, 8 aa, Plasmodium falciparum
PNYSSSPP

SEQ ID NO: 3401581 - protein, 5 aa, Plasmodium falciparum
PPESF

SEQ ID NO: 3401582 - protein, 17 aa, Plasmodium falciparum
PPKIKRGNHLKSSQISE

SEQ ID NO: 3401583 - protein, 16 aa, Plasmodium falciparum
PPKVPEPERPHEPEME

SEQ ID NO: 3401584 - protein, 7 aa, Plasmodium falciparum
PPNVKPN

SEQ ID NO: 3401585 - protein, 5 aa, Plasmodium falciparum
PPPIN

SEQ ID NO: 3401586 - protein, 5 aa, Plasmodium falciparum
PPPNT

SEQ ID NO: 3401587 - protein, 4 aa, Plasmodium falciparum
PQEG

SEQ ID NO: 3401588 - protein, 7 aa, Plasmodium falciparum
PQGFSKN

SEQ ID NO: 3401589 - protein, 6 aa, Plasmodium falciparum
PQKSKN

SEQ ID NO: 3401590 - protein, 4 aa, Plasmodium falciparum
PQPF

SEQ ID NO: 3401591 - protein, 15 aa, Plasmodium falciparum
PQSAQNYDRNKFSGT

SEQ ID NO: 3401592 - protein, 28 aa, Plasmodium falciparum
PQVEPEPGPLPEEVREPEPEPEAEPEKE

SEQ ID NO: 3401593 - protein, 5 aa, Plasmodium falciparum
PQYGE

SEQ ID NO: 3401594 - protein, 4 aa, Plasmodium falciparum
PRSA

SEQ ID NO: 3401595 - protein, 5 aa, Plasmodium falciparum
PSDEE

SEQ ID NO: 3401596 - protein, 4 aa, Plasmodium falciparum
PSDG

SEQ ID NO: 3401597 - protein, 6 aa, Plasmodium falciparum
PSENDF

SEQ ID NO: 3401598 - protein, 7 aa, Plasmodium falciparum
PSENPKY

SEQ ID NO: 3401599 - protein, 5 aa, Plasmodium falciparum
PSERN

SEQ ID NO: 3401600 - protein, 9 aa, Plasmodium falciparum
PSFGDRRKD

SEQ ID NO: 3401601 - protein, 42 aa, Plasmodium falciparum
PSGNNTTASGNNTTASGKNTPSDTQNDIQSDGIPSSKITDNE

SEQ ID NO: 3401602 - protein, 5 aa, Plasmodium falciparum
PSIGG

SEQ ID NO: 3401603 - protein, 8 aa, Plasmodium falciparum
PSKKNTTL

SEQ ID NO: 3401604 - protein, 12 aa, Plasmodium falciparum
PSKSTPYQSEYE

SEQ ID NO: 3401605 - protein, 5 aa, Plasmodium falciparum
PSNET

SEQ ID NO: 3401606 - protein, 4 aa, Plasmodium falciparum
PSNI

SEQ ID NO: 3401607 - protein, 9 aa, Plasmodium falciparum
PSNNDEQVL

SEQ ID NO: 3401608 - protein, 4 aa, Plasmodium falciparum
PSPT

SEQ ID NO: 3401609 - protein, 10 aa, Plasmodium falciparum
PSRIEGGKRN

SEQ ID NO: 3401610 - protein, 102 aa, Plasmodium falciparum
PSSHGSSKKTMKENENEEEDEEVNEDQNEDQNDDENEDQNDDENEDQNEDEYEEEDDDEKEDEEEEDEDEENEDEEDNDKEDEDDEDNDDEEVNEDEENEEQ

SEQ ID NO: 3401611 - protein, 67 aa, Plasmodium falciparum
PSSPTQNDGSTGRNVPPPSEPNVDTPDPPTAPAPVKVPEDAKLSSSPRPEGPRANNRNENNQNTDPY

SEQ ID NO: 3401612 - protein, 4 aa, Plasmodium falciparum
PSVD

SEQ ID NO: 3401613 - protein, 19 aa, Plasmodium falciparum
PTEGDYSYEQSKVGETCPE

SEQ ID NO: 3401614 - protein, 4 aa, Plasmodium falciparum
PTIT

SEQ ID NO: 3401615 - protein, 6 aa, Plasmodium falciparum
PTKKSN

SEQ ID NO: 3401616 - protein, 5 aa, Plasmodium falciparum
PTKPY

SEQ ID NO: 3401617 - protein, 6 aa, Plasmodium falciparum
PTKYES

SEQ ID NO: 3401618 - protein, 8 aa, Plasmodium falciparum
PTNDGCEN

SEQ ID NO: 3401619 - protein, 6 aa, Plasmodium falciparum
PTNEKT

SEQ ID NO: 3401620 - protein, 5 aa, Plasmodium falciparum
PTSND

SEQ ID NO: 3401621 - protein, 8 aa, Plasmodium falciparum
PVNKDESS

SEQ ID NO: 3401622 - protein, 39 aa, Plasmodium falciparum
PVPIPKNSNTNKDDSINNKQDGSQNNTTTNHFPKPREQL

SEQ ID NO: 3401623 - protein, 8 aa, Plasmodium falciparum
PWGKGRPG

SEQ ID NO: 3401624 - protein, 5 aa, Plasmodium falciparum
PWPST

SEQ ID NO: 3401625 - protein, 10 aa, Plasmodium falciparum
PYSEEGDKKV

SEQ ID NO: 3401626 - protein, 7 aa, Plasmodium falciparum
PYSPSSK

SEQ ID NO: 3401627 - protein, 22 aa, Plasmodium falciparum
QAAPEPKADDGNINNNNNNNGN

SEQ ID NO: 3401628 - protein, 7 aa, Plasmodium falciparum
QAHAGDA

SEQ ID NO: 3401629 - protein, 5 aa, Plasmodium falciparum
QASEP

SEQ ID NO: 3401630 - protein, 6 aa, Plasmodium falciparum
QCQGGK

SEQ ID NO: 3401631 - protein, 5 aa, Plasmodium falciparum
QDAEG

SEQ ID NO: 3401632 - protein, 48 aa, Plasmodium falciparum
QDEEKQKSELDDDEQEIGSNKKGKKKIGDENDQQEEDTDENDLTKKDI

SEQ ID NO: 3401633 - protein, 5 aa, Plasmodium falciparum
QDGET

SEQ ID NO: 3401634 - protein, 11 aa, Plasmodium falciparum
QDKDSKPTNID

SEQ ID NO: 3401635 - protein, 8 aa, Plasmodium falciparum
QDKKKGKL

SEQ ID NO: 3401636 - protein, 5 aa, Plasmodium falciparum
QDNKI

SEQ ID NO: 3401637 - protein, 25 aa, Plasmodium falciparum
QDNKNKVEETHEEQGEMTQEEKDEI

SEQ ID NO: 3401638 - protein, 25 aa, Plasmodium falciparum
QDPEKDDILSENSSNKYKKKKKNDM

SEQ ID NO: 3401639 - protein, 15 aa, Plasmodium falciparum
QDTKDKTKNTDDDDD

SEQ ID NO: 3401640 - protein, 93 aa, Plasmodium falciparum
QDTTPVENEAPRSGVQKPTELSSTESQTVSPPNESQTESLLSGGSQVTNPTLTQSTSSSSGQQETGPLSTQGLSPATGDPKGKEQEASPAEGL

SEQ ID NO: 3401641 - protein, 25 aa, Plasmodium falciparum
QDTVEEKEKINDSGNEKDNHNFNSN

SEQ ID NO: 3401642 - protein, 5 aa, Plasmodium falciparum
QEDKE

SEQ ID NO: 3401643 - protein, 10 aa, Plasmodium falciparum
QEDKKATFSF

SEQ ID NO: 3401644 - protein, 5 aa, Plasmodium falciparum
QEEKI

SEQ ID NO: 3401645 - protein, 9 aa, Plasmodium falciparum
QEENENTGN

SEQ ID NO: 3401646 - protein, 10 aa, Plasmodium falciparum
QEEQKKLDNY

SEQ ID NO: 3401647 - protein, 9 aa, Plasmodium falciparum
QEETDDDYD

SEQ ID NO: 3401648 - protein, 5 aa, Plasmodium falciparum
QEGDN

SEQ ID NO: 3401649 - protein, 44 aa, Plasmodium falciparum
QEGQTDNEGPHTETKPERSVESGGTGDSVSNHESELPRDTETRE

SEQ ID NO: 3401650 - protein, 11 aa, Plasmodium falciparum
QEHSEQPTNKI

SEQ ID NO: 3401651 - protein, 7 aa, Plasmodium falciparum
QEINEAN

SEQ ID NO: 3401652 - protein, 8 aa, Plasmodium falciparum
QEKEPPPM

SEQ ID NO: 3401653 - protein, 10 aa, Plasmodium falciparum
QEKKKRRKIK

SEQ ID NO: 3401654 - protein, 8 aa, Plasmodium falciparum
QEKLEENY

SEQ ID NO: 3401655 - protein, 4 aa, Plasmodium falciparum
QEKP

SEQ ID NO: 3401656 - protein, 77 aa, Plasmodium falciparum
QEKPPPDSTVGANPGDERESSGRVNNPASGEQGTTNSPTEQPDQTRDRSSSVPQGSPREPVSPENPNPVTQIPGNGG

SEQ ID NO: 3401657 - protein, 7 aa, Plasmodium falciparum
QEKPRDK

SEQ ID NO: 3401658 - protein, 8 aa, Plasmodium falciparum
QEKTEHIQ

SEQ ID NO: 3401659 - protein, 13 aa, Plasmodium falciparum
QEKYNNDDSLKST

SEQ ID NO: 3401660 - protein, 4 aa, Plasmodium falciparum
QENK

SEQ ID NO: 3401661 - protein, 5 aa, Plasmodium falciparum
QENPL

SEQ ID NO: 3401662 - protein, 14 aa, Plasmodium falciparum
QENQKSQNDNGNNH

SEQ ID NO: 3401663 - protein, 8 aa, Plasmodium falciparum
QEPNENKL

SEQ ID NO: 3401664 - protein, 5 aa, Plasmodium falciparum
QEQCE

SEQ ID NO: 3401665 - protein, 6 aa, Plasmodium falciparum
QESGKY

SEQ ID NO: 3401666 - protein, 6 aa, Plasmodium falciparum
QETKYP

SEQ ID NO: 3401667 - protein, 70 aa, Plasmodium falciparum
QETQPQQQQQQKEVGSGIGAEQKVESARPGAEVSQSDVERAGRSSGTGGSVGTKISPGSQGQGKVAGPQL

SEQ ID NO: 3401668 - protein, 7 aa, Plasmodium falciparum
QEYNEKD

SEQ ID NO: 3401669 - protein, 7 aa, Plasmodium falciparum
QGIDTTK

SEQ ID NO: 3401670 - protein, 5 aa, Plasmodium falciparum
QGIKD

SEQ ID NO: 3401671 - protein, 7 aa, Plasmodium falciparum
QGKPGEL

SEQ ID NO: 3401672 - protein, 8 aa, Plasmodium falciparum
QGNIPNPI

SEQ ID NO: 3401673 - protein, 11 aa, Plasmodium falciparum
QGNTKVPGNVP

SEQ ID NO: 3401674 - protein, 4 aa, Plasmodium falciparum
QGQG

SEQ ID NO: 3401675 - protein, 5 aa, Plasmodium falciparum
QGQNG

SEQ ID NO: 3401676 - protein, 4 aa, Plasmodium falciparum
QGSI

SEQ ID NO: 3401677 - protein, 5 aa, Plasmodium falciparum
QGTPF

SEQ ID NO: 3401678 - protein, 7 aa, Plasmodium falciparum
QHETYSS

SEQ ID NO: 3401679 - protein, 11 aa, Plasmodium falciparum
QHNEKDKCSQH

SEQ ID NO: 3401680 - protein, 10 aa, Plasmodium falciparum
QHNTTSNIKR

SEQ ID NO: 3401681 - protein, 190 aa, Plasmodium falciparum
QIGKEENNLVGQQNDSVGQQNDSVGQQNDSVGQQNDPVGQQNDSVGQQNDPVGQQNDPVGQQNDYVGQQNDSVGQQNDYVGQQNDYVGQQNDPVGQQNDSVGQQNDYVGQQNDPVGQQNDPVGQQNDPVGQQNDSVGQQNDYVGQQNDPVGQQNDYVGQQNDYVGQQNDPVGQQNDPVGQQNDPVEQEDN

SEQ ID NO: 3401682 - protein, 4 aa, Plasmodium falciparum
QIGN

SEQ ID NO: 3401683 - protein, 12 aa, Plasmodium falciparum
QIKKKKKNYIKY

SEQ ID NO: 3401684 - protein, 11 aa, Plasmodium falciparum
QINQDNINGQN

SEQ ID NO: 3401685 - protein, 6 aa, Plasmodium falciparum
QKDEPN

SEQ ID NO: 3401686 - protein, 71 aa, Plasmodium falciparum
QKDGAGDTKDNKKEGDEENNNNNNNEEINKDDDTNNNKSDDEQNKGDENKSNDENKENEENKQNGEKKKND

SEQ ID NO: 3401687 - protein, 9 aa, Plasmodium falciparum
QKDTKEEKH

SEQ ID NO: 3401688 - protein, 4 aa, Plasmodium falciparum
QKEC

SEQ ID NO: 3401689 - protein, 19 aa, Plasmodium falciparum
QKGNEQEKYKDNEQKLNND

SEQ ID NO: 3401690 - protein, 10 aa, Plasmodium falciparum
QKGPYEVKNE

SEQ ID NO: 3401691 - protein, 7 aa, Plasmodium falciparum
QKKANGK

SEQ ID NO: 3401692 - protein, 7 aa, Plasmodium falciparum
QKKEELN

SEQ ID NO: 3401693 - protein, 8 aa, Plasmodium falciparum
QKKKGKGH

SEQ ID NO: 3401694 - protein, 10 aa, Plasmodium falciparum
QKKKNKNEQI

SEQ ID NO: 3401695 - protein, 19 aa, Plasmodium falciparum
QKKYNKNDMGNKQKDNKKF

SEQ ID NO: 3401696 - protein, 5 aa, Plasmodium falciparum
QKNKK

SEQ ID NO: 3401697 - protein, 7 aa, Plasmodium falciparum
QKNPDEL

SEQ ID NO: 3401698 - protein, 18 aa, Plasmodium falciparum
QKNRKNNISYDSSNSHYN

SEQ ID NO: 3401699 - protein, 6 aa, Plasmodium falciparum
QKNSNE

SEQ ID NO: 3401700 - protein, 8 aa, Plasmodium falciparum
QKNVDDTS

SEQ ID NO: 3401701 - protein, 5 aa, Plasmodium falciparum
QKPIK

SEQ ID NO: 3401702 - protein, 9 aa, Plasmodium falciparum
QKRDGKETF

SEQ ID NO: 3401703 - protein, 42 aa, Plasmodium falciparum
QKRKSRSQEKNKSTSQEKNKSTSQEKNKSKSKEKNTSTLPQD

SEQ ID NO: 3401704 - protein, 4 aa, Plasmodium falciparum
QKRP

SEQ ID NO: 3401705 - protein, 33 aa, Plasmodium falciparum
QKSDAVQNGVQKSDTLQNGVERNYNDNNSVNDH

SEQ ID NO: 3401706 - protein, 9 aa, Plasmodium falciparum
QKSDKHEIQ

SEQ ID NO: 3401707 - protein, 9 aa, Plasmodium falciparum
QKSFPKNEG

SEQ ID NO: 3401708 - protein, 42 aa, Plasmodium falciparum
QKSQDDQLSHSSDNNNNNDNNDNNDNNDNNDNNDNNDNNNNV

SEQ ID NO: 3401709 - protein, 7 aa, Plasmodium falciparum
QKSRLTK

SEQ ID NO: 3401710 - protein, 6 aa, Plasmodium falciparum
QKSTNE

SEQ ID NO: 3401711 - protein, 8 aa, Plasmodium falciparum
QLANSNKQ

SEQ ID NO: 3401712 - protein, 4 aa, Plasmodium falciparum
QLDE

SEQ ID NO: 3401713 - protein, 16 aa, Plasmodium falciparum
QLEKASESLGLGNPND

SEQ ID NO: 3401714 - protein, 18 aa, Plasmodium falciparum
QLEPQEKPNIESFEPKNI

SEQ ID NO: 3401715 - protein, 14 aa, Plasmodium falciparum
QLQQEKNKREQELS

SEQ ID NO: 3401716 - protein, 15 aa, Plasmodium falciparum
QNDQNSNTFDFDTDE

SEQ ID NO: 3401717 - protein, 6 aa, Plasmodium falciparum
QNEDPD

SEQ ID NO: 3401718 - protein, 6 aa, Plasmodium falciparum
QNEDPN

SEQ ID NO: 3401719 - protein, 8 aa, Plasmodium falciparum
QNEDVEKP

SEQ ID NO: 3401720 - protein, 73 aa, Plasmodium falciparum
QNEGIENNNTQMKGKQIKDAQMKGKQNNNTQMKGKQNNNTQMKGKQNNNTQMNDAQMNDAQNYDGKDNNSECL

SEQ ID NO: 3401721 - protein, 8 aa, Plasmodium falciparum
QNINDDTE

SEQ ID NO: 3401722 - protein, 9 aa, Plasmodium falciparum
QNINDPHRK

SEQ ID NO: 3401723 - protein, 16 aa, Plasmodium falciparum
QNIQEDDNDEEDDDDI

SEQ ID NO: 3401724 - protein, 4 aa, Plasmodium falciparum
QNIY

SEQ ID NO: 3401725 - protein, 9 aa, Plasmodium falciparum
QNKDKKNLD

SEQ ID NO: 3401726 - protein, 12 aa, Plasmodium falciparum
QNKNITKYSRSA

SEQ ID NO: 3401727 - protein, 4 aa, Plasmodium falciparum
QNKQ

SEQ ID NO: 3401728 - protein, 9 aa, Plasmodium falciparum
QNKSKKNKE

SEQ ID NO: 3401729 - protein, 4 aa, Plasmodium falciparum
QNKY

SEQ ID NO: 3401730 - protein, 6 aa, Plasmodium falciparum
QNKYDS

SEQ ID NO: 3401731 - protein, 8 aa, Plasmodium falciparum
QNLSTTNY

SEQ ID NO: 3401732 - protein, 12 aa, Plasmodium falciparum
QNMNDNRDTKCY

SEQ ID NO: 3401733 - protein, 4 aa, Plasmodium falciparum
QNMP

SEQ ID NO: 3401734 - protein, 6 aa, Plasmodium falciparum
QNNEEK

SEQ ID NO: 3401735 - protein, 9 aa, Plasmodium falciparum
QNNKEGEKP

SEQ ID NO: 3401736 - protein, 10 aa, Plasmodium falciparum
QNNKNEDEIE

SEQ ID NO: 3401737 - protein, 7 aa, Plasmodium falciparum
QNPNVDP

SEQ ID NO: 3401738 - protein, 7 aa, Plasmodium falciparum
QNPRHEN

SEQ ID NO: 3401739 - protein, 5 aa, Plasmodium falciparum
QNQDE

SEQ ID NO: 3401740 - protein, 5 aa, Plasmodium falciparum
QNQKN

SEQ ID NO: 3401741 - protein, 7 aa, Plasmodium falciparum
QNSDATS

SEQ ID NO: 3401742 - protein, 10 aa, Plasmodium falciparum
QNSNGDEKLQ

SEQ ID NO: 3401743 - protein, 10 aa, Plasmodium falciparum
QNSNNSSTEQ

SEQ ID NO: 3401744 - protein, 15 aa, Plasmodium falciparum
QNSPRRKHTHGKGLE

SEQ ID NO: 3401745 - protein, 8 aa, Plasmodium falciparum
QNTREEPT

SEQ ID NO: 3401746 - protein, 6 aa, Plasmodium falciparum
QNTSGY

SEQ ID NO: 3401747 - protein, 20 aa, Plasmodium falciparum
QNTYSTNNSKTSKPNDNSMS

SEQ ID NO: 3401748 - protein, 8 aa, Plasmodium falciparum
QNYKSNNK

SEQ ID NO: 3401749 - protein, 7 aa, Plasmodium falciparum
QNYQDNN

SEQ ID NO: 3401750 - protein, 12 aa, Plasmodium falciparum
QPDKQQEKDELS

SEQ ID NO: 3401751 - protein, 8 aa, Plasmodium falciparum
QPEQETNI

SEQ ID NO: 3401752 - protein, 14 aa, Plasmodium falciparum
QPGESEVVLNSFKT

SEQ ID NO: 3401753 - protein, 7 aa, Plasmodium falciparum
QPHRNSS

SEQ ID NO: 3401754 - protein, 4 aa, Plasmodium falciparum
QPLP

SEQ ID NO: 3401755 - protein, 7 aa, Plasmodium falciparum
QPSDVPN

SEQ ID NO: 3401756 - protein, 12 aa, Plasmodium falciparum
QQAKHIHNPFII

SEQ ID NO: 3401757 - protein, 6 aa, Plasmodium falciparum
QQEDDE

SEQ ID NO: 3401758 - protein, 10 aa, Plasmodium falciparum
QQIRNRTSGP

SEQ ID NO: 3401759 - protein, 11 aa, Plasmodium falciparum
QQNAKELAEGK

SEQ ID NO: 3401760 - protein, 12 aa, Plasmodium falciparum
QQNKKEDQVEEK

SEQ ID NO: 3401761 - protein, 6 aa, Plasmodium falciparum
QQQNSV

SEQ ID NO: 3401762 - protein, 10 aa, Plasmodium falciparum
QRDSENGSTT

SEQ ID NO: 3401763 - protein, 5 aa, Plasmodium falciparum
QREKN

SEQ ID NO: 3401764 - protein, 24 aa, Plasmodium falciparum
QRKKEKKKLDPNDKFDQKKLPLII

SEQ ID NO: 3401765 - protein, 5 aa, Plasmodium falciparum
QRKND

SEQ ID NO: 3401766 - protein, 10 aa, Plasmodium falciparum
QSAVTDDKDE

SEQ ID NO: 3401767 - protein, 10 aa, Plasmodium falciparum
QSEEQTDTNF

SEQ ID NO: 3401768 - protein, 4 aa, Plasmodium falciparum
QSEF

SEQ ID NO: 3401769 - protein, 19 aa, Plasmodium falciparum
QSEKSSSKVDNNKNNTNEI

SEQ ID NO: 3401770 - protein, 5 aa, Plasmodium falciparum
QSEKV

SEQ ID NO: 3401771 - protein, 6 aa, Plasmodium falciparum
QSGDRN

SEQ ID NO: 3401772 - protein, 4 aa, Plasmodium falciparum
QSGI

SEQ ID NO: 3401773 - protein, 5 aa, Plasmodium falciparum
QSGTK

SEQ ID NO: 3401774 - protein, 4 aa, Plasmodium falciparum
QSIS

SEQ ID NO: 3401775 - protein, 14 aa, Plasmodium falciparum
QSKGNSGTEGDGSS

SEQ ID NO: 3401776 - protein, 7 aa, Plasmodium falciparum
QSKKTSY

SEQ ID NO: 3401777 - protein, 8 aa, Plasmodium falciparum
QSNENLLP

SEQ ID NO: 3401778 - protein, 4 aa, Plasmodium falciparum
QSNI

SEQ ID NO: 3401779 - protein, 8 aa, Plasmodium falciparum
QSPPRKIQ

SEQ ID NO: 3401780 - protein, 37 aa, Plasmodium falciparum
QSRDDNNNNNNNNNNNNNNNNNNNNNNNNNNNNDNNN

SEQ ID NO: 3401781 - protein, 9 aa, Plasmodium falciparum
QSRTTNTVD

SEQ ID NO: 3401782 - protein, 12 aa, Plasmodium falciparum
QSSKYHPVCYVT

SEQ ID NO: 3401783 - protein, 16 aa, Plasmodium falciparum
QSTHSTPVNNEEDQEE

SEQ ID NO: 3401784 - protein, 8 aa, Plasmodium falciparum
QSTNKNVR

SEQ ID NO: 3401785 - protein, 4 aa, Plasmodium falciparum
QSYV

SEQ ID NO: 3401786 - protein, 13 aa, Plasmodium falciparum
QTCTTPGDKNGRK

SEQ ID NO: 3401787 - protein, 13 aa, Plasmodium falciparum
QTDPNKKDDNKKN

SEQ ID NO: 3401788 - protein, 7 aa, Plasmodium falciparum
QTDYSYP

SEQ ID NO: 3401789 - protein, 17 aa, Plasmodium falciparum
QTGKEGAEGGVNKENQM

SEQ ID NO: 3401790 - protein, 9 aa, Plasmodium falciparum
QTKERTEVD

SEQ ID NO: 3401791 - protein, 7 aa, Plasmodium falciparum
QTKGQIG

SEQ ID NO: 3401792 - protein, 40 aa, Plasmodium falciparum
QTKNNNNNNNNSSGSSSSSSSSSSSSSSNIGVKKNESGDD

SEQ ID NO: 3401793 - protein, 14 aa, Plasmodium falciparum
QTNDAISNNNNNSY

SEQ ID NO: 3401794 - protein, 25 aa, Plasmodium falciparum
QTNKNSQENKSLEENKKNNLHPSNV

SEQ ID NO: 3401795 - protein, 4 aa, Plasmodium falciparum
QTNN

SEQ ID NO: 3401796 - protein, 6 aa, Plasmodium falciparum
QTNNAT

SEQ ID NO: 3401797 - protein, 12 aa, Plasmodium falciparum
QTNPDKKHEQAQ

SEQ ID NO: 3401798 - protein, 9 aa, Plasmodium falciparum
QTNPLPNTP

SEQ ID NO: 3401799 - protein, 13 aa, Plasmodium falciparum
QTRAGAPLDNKSK

SEQ ID NO: 3401800 - protein, 11 aa, Plasmodium falciparum
QTSDESTSKSI

SEQ ID NO: 3401801 - protein, 4 aa, Plasmodium falciparum
QTSN

SEQ ID NO: 3401802 - protein, 8 aa, Plasmodium falciparum
QTTSSCGN

SEQ ID NO: 3401803 - protein, 6 aa, Plasmodium falciparum
QTYNIN

SEQ ID NO: 3401804 - protein, 4 aa, Plasmodium falciparum
QVDT

SEQ ID NO: 3401805 - protein, 9 aa, Plasmodium falciparum
QVEADPNTF

SEQ ID NO: 3401806 - protein, 13 aa, Plasmodium falciparum
QYETKKGKDISNN

SEQ ID NO: 3401807 - protein, 5 aa, Plasmodium falciparum
QYNEG

SEQ ID NO: 3401808 - protein, 5 aa, Plasmodium falciparum
QYNRT

SEQ ID NO: 3401809 - protein, 5 aa, Plasmodium falciparum
QYREQ

SEQ ID NO: 3401810 - protein, 5 aa, Plasmodium falciparum
QYTKV

SEQ ID NO: 3401811 - protein, 21 aa, Plasmodium falciparum
QYTQNNEYNNKSLKDYNSTQK

SEQ ID NO: 3401812 - protein, 11 aa, Plasmodium falciparum
RAEENYTKLEG

SEQ ID NO: 3401813 - protein, 7 aa, Plasmodium falciparum
RAENSNT

SEQ ID NO: 3401814 - protein, 33 aa, Plasmodium falciparum
RAFEDDDMDADNTEDDKDEADDASQQKSPAIDE

SEQ ID NO: 3401815 - protein, 8 aa, Plasmodium falciparum
RAKKSSNR

SEQ ID NO: 3401816 - protein, 4 aa, Plasmodium falciparum
RALT

SEQ ID NO: 3401817 - protein, 4 aa, Plasmodium falciparum
RAND

SEQ ID NO: 3401818 - protein, 5 aa, Plasmodium falciparum
RAREV

SEQ ID NO: 3401819 - protein, 13 aa, Plasmodium falciparum
RARPGESRKNPRE

SEQ ID NO: 3401820 - protein, 6 aa, Plasmodium falciparum
RASGTY

SEQ ID NO: 3401821 - protein, 8 aa, Plasmodium falciparum
RDELRDER

SEQ ID NO: 3401822 - protein, 6 aa, Plasmodium falciparum
RDITEK

SEQ ID NO: 3401823 - protein, 7 aa, Plasmodium falciparum
RDKESSK

SEQ ID NO: 3401824 - protein, 7 aa, Plasmodium falciparum
RDKNYGN

SEQ ID NO: 3401825 - protein, 8 aa, Plasmodium falciparum
RDKTNNKK

SEQ ID NO: 3401826 - protein, 9 aa, Plasmodium falciparum
RDRDDQNNQ

SEQ ID NO: 3401827 - protein, 26 aa, Plasmodium falciparum
RDSEGSESDVPKDKVKPFPDGRSPDS

SEQ ID NO: 3401828 - protein, 7 aa, Plasmodium falciparum
RDSRRAC

SEQ ID NO: 3401829 - protein, 9 aa, Plasmodium falciparum
RDTPEVQQQ

SEQ ID NO: 3401830 - protein, 12 aa, Plasmodium falciparum
RDVSQDVSQDIN

SEQ ID NO: 3401831 - protein, 17 aa, Plasmodium falciparum
RDYNTESIGGPIAPNTK

SEQ ID NO: 3401832 - protein, 4 aa, Plasmodium falciparum
RDYP

SEQ ID NO: 3401833 - protein, 7 aa, Plasmodium falciparum
REEEIKK

SEQ ID NO: 3401834 - protein, 110 aa, Plasmodium falciparum
REETIPGDHSGEKNGNTLKDDEGGGDGDDDDDDVGDDNVDDGDDDDDDVGDDNVDDDDGNDDDDDDNDDDDNDDDDNDDDDNDDDDDDDNENSDKSSHHNKQSNDNEKYI

SEQ ID NO: 3401835 - protein, 5 aa, Plasmodium falciparum
REGDE

SEQ ID NO: 3401836 - protein, 4 aa, Plasmodium falciparum
REKP

SEQ ID NO: 3401837 - protein, 8 aa, Plasmodium falciparum
REKVNGES

SEQ ID NO: 3401838 - protein, 14 aa, Plasmodium falciparum
RENEKKKKKNALTS

SEQ ID NO: 3401839 - protein, 5 aa, Plasmodium falciparum
RENYY

SEQ ID NO: 3401840 - protein, 21 aa, Plasmodium falciparum
REPLDVPDEPEDDQPRPRGDN

SEQ ID NO: 3401841 - protein, 5 aa, Plasmodium falciparum
REQSP

SEQ ID NO: 3401842 - protein, 11 aa, Plasmodium falciparum
RERNIKNYTSQ

SEQ ID NO: 3401843 - protein, 38 aa, Plasmodium falciparum
REVDEKKKKNKKDIDSKENSKSGNNIYNKDNTKNNEDV

SEQ ID NO: 3401844 - protein, 6 aa, Plasmodium falciparum
REYNVP

SEQ ID NO: 3401845 - protein, 5 aa, Plasmodium falciparum
RFKGS

SEQ ID NO: 3401846 - protein, 4 aa, Plasmodium falciparum
RGDF

SEQ ID NO: 3401847 - protein, 5 aa, Plasmodium falciparum
RGSKT

SEQ ID NO: 3401848 - protein, 5 aa, Plasmodium falciparum
RGVQG

SEQ ID NO: 3401849 - protein, 33 aa, Plasmodium falciparum
RHEETSSEGNENLNRNTKHNNDNNNDNNNYSED

SEQ ID NO: 3401850 - protein, 12 aa, Plasmodium falciparum
RIETNDGENEYA

SEQ ID NO: 3401851 - protein, 16 aa, Plasmodium falciparum
RIHNDNPTNHKPDQYD

SEQ ID NO: 3401852 - protein, 5 aa, Plasmodium falciparum
RINKN

SEQ ID NO: 3401853 - protein, 17 aa, Plasmodium falciparum
RKCQNEVKEYSKKDTRL

SEQ ID NO: 3401854 - protein, 7 aa, Plasmodium falciparum
RKDDNED

SEQ ID NO: 3401855 - protein, 7 aa, Plasmodium falciparum
RKEDNIK

SEQ ID NO: 3401856 - protein, 6 aa, Plasmodium falciparum
RKEDNN

SEQ ID NO: 3401857 - protein, 6 aa, Plasmodium falciparum
RKEHKN

SEQ ID NO: 3401858 - protein, 8 aa, Plasmodium falciparum
RKEKENIE

SEQ ID NO: 3401859 - protein, 11 aa, Plasmodium falciparum
RKGGPLPPPEL

SEQ ID NO: 3401860 - protein, 7 aa, Plasmodium falciparum
RKGKKVQ

SEQ ID NO: 3401861 - protein, 9 aa, Plasmodium falciparum
RKGKNNGNF

SEQ ID NO: 3401862 - protein, 5 aa, Plasmodium falciparum
RKGPN

SEQ ID NO: 3401863 - protein, 31 aa, Plasmodium falciparum
RKGTNDKTKENETFEKGEVKEEEEEKDKNVK

SEQ ID NO: 3401864 - protein, 5 aa, Plasmodium falciparum
RKHQQ

SEQ ID NO: 3401865 - protein, 6 aa, Plasmodium falciparum
RKIQKK

SEQ ID NO: 3401866 - protein, 8 aa, Plasmodium falciparum
RKKDKMNA

SEQ ID NO: 3401867 - protein, 14 aa, Plasmodium falciparum
RKKECSGKGYKTIT

SEQ ID NO: 3401868 - protein, 8 aa, Plasmodium falciparum
RKKEIEKK

SEQ ID NO: 3401869 - protein, 5 aa, Plasmodium falciparum
RKKGK

SEQ ID NO: 3401870 - protein, 9 aa, Plasmodium falciparum
RKKKKRDLI

SEQ ID NO: 3401871 - protein, 19 aa, Plasmodium falciparum
RKKKYKYIPSNGTTQSNNI

SEQ ID NO: 3401872 - protein, 65 aa, Plasmodium falciparum
RKKNTKGDEHVDEKEKKQKRDDDINENKENNKNNENNKNDENNENNKNDENNKNNDNNNNNNNSC

SEQ ID NO: 3401873 - protein, 7 aa, Plasmodium falciparum
RKKPGRN

SEQ ID NO: 3401874 - protein, 5 aa, Plasmodium falciparum
RKKRE

SEQ ID NO: 3401875 - protein, 7 aa, Plasmodium falciparum
RKKYENR

SEQ ID NO: 3401876 - protein, 9 aa, Plasmodium falciparum
RKNKSYLEN

SEQ ID NO: 3401877 - protein, 14 aa, Plasmodium falciparum
RKNNDERKRNPFDA

SEQ ID NO: 3401878 - protein, 8 aa, Plasmodium falciparum
RKNQKDSY

SEQ ID NO: 3401879 - protein, 7 aa, Plasmodium falciparum
RKNSAGS

SEQ ID NO: 3401880 - protein, 9 aa, Plasmodium falciparum
RKNTKSSTF

SEQ ID NO: 3401881 - protein, 6 aa, Plasmodium falciparum
RKPIKY

SEQ ID NO: 3401882 - protein, 8 aa, Plasmodium falciparum
RKQRRKEI

SEQ ID NO: 3401883 - protein, 7 aa, Plasmodium falciparum
RKRKDVD

SEQ ID NO: 3401884 - protein, 10 aa, Plasmodium falciparum
RKRSGVDKNN

SEQ ID NO: 3401885 - protein, 8 aa, Plasmodium falciparum
RKSEPMSD

SEQ ID NO: 3401886 - protein, 7 aa, Plasmodium falciparum
RKTVSRS

SEQ ID NO: 3401887 - protein, 4 aa, Plasmodium falciparum
RKYL

SEQ ID NO: 3401888 - protein, 8 aa, Plasmodium falciparum
RLARGANT

SEQ ID NO: 3401889 - protein, 86 aa, Plasmodium falciparum
RLDDTSSSENVKNDDNKNMSGDNNNDNNNNMSGDNNNNMSGDNNNNMSGDNNNNMSGDDYVEGKQNINRNERNIERHNNNDNNNNN

SEQ ID NO: 3401890 - protein, 7 aa, Plasmodium falciparum
RLDPNDK

SEQ ID NO: 3401891 - protein, 26 aa, Plasmodium falciparum
RLNFNGDQKDEDNEENDDKDENTLEN

SEQ ID NO: 3401892 - protein, 4 aa, Plasmodium falciparum
RLPT

SEQ ID NO: 3401893 - protein, 8 aa, Plasmodium falciparum
RLQQNGSN

SEQ ID NO: 3401894 - protein, 5 aa, Plasmodium falciparum
RLRSN

SEQ ID NO: 3401895 - protein, 5 aa, Plasmodium falciparum
RLSSK

SEQ ID NO: 3401896 - protein, 12 aa, Plasmodium falciparum
RNANKTSKDKRV

SEQ ID NO: 3401897 - protein, 9 aa, Plasmodium falciparum
RNDKEQNKD

SEQ ID NO: 3401898 - protein, 12 aa, Plasmodium falciparum
RNEEENDNNKNI

SEQ ID NO: 3401899 - protein, 6 aa, Plasmodium falciparum
RNEQTD

SEQ ID NO: 3401900 - protein, 10 aa, Plasmodium falciparum
RNETSNDKIK

SEQ ID NO: 3401901 - protein, 5 aa, Plasmodium falciparum
RNGTK

SEQ ID NO: 3401902 - protein, 25 aa, Plasmodium falciparum
RNHQNVKNESENGNYNNDHNDHQTC

SEQ ID NO: 3401903 - protein, 37 aa, Plasmodium falciparum
RNKNSEHKENDSHQQKDVNNEERKKKKKSKKYQDGKI

SEQ ID NO: 3401904 - protein, 11 aa, Plasmodium falciparum
RNLDEEDMSPR

SEQ ID NO: 3401905 - protein, 12 aa, Plasmodium falciparum
RNLGDYNKNKMG

SEQ ID NO: 3401906 - protein, 11 aa, Plasmodium falciparum
RNMNNNSSFAE

SEQ ID NO: 3401907 - protein, 7 aa, Plasmodium falciparum
RNNDDSL

SEQ ID NO: 3401908 - protein, 6 aa, Plasmodium falciparum
RNNIES

SEQ ID NO: 3401909 - protein, 6 aa, Plasmodium falciparum
RNNKNN

SEQ ID NO: 3401910 - protein, 10 aa, Plasmodium falciparum
RNNKSHNNLP

SEQ ID NO: 3401911 - protein, 22 aa, Plasmodium falciparum
RNNNNEDGGDDNNNNNNNNNNN

SEQ ID NO: 3401912 - protein, 8 aa, Plasmodium falciparum
RNSEKDNL

SEQ ID NO: 3401913 - protein, 6 aa, Plasmodium falciparum
RNSREN

SEQ ID NO: 3401914 - protein, 9 aa, Plasmodium falciparum
RNSSTLESG

SEQ ID NO: 3401915 - protein, 5 aa, Plasmodium falciparum
RNTDI

SEQ ID NO: 3401916 - protein, 18 aa, Plasmodium falciparum
RNTPKSYTISSSPKESKD

SEQ ID NO: 3401917 - protein, 5 aa, Plasmodium falciparum
RNVPK

SEQ ID NO: 3401918 - protein, 10 aa, Plasmodium falciparum
RNYEDKSRKL

SEQ ID NO: 3401919 - protein, 5 aa, Plasmodium falciparum
RPEWK

SEQ ID NO: 3401920 - protein, 6 aa, Plasmodium falciparum
RPLSQP

SEQ ID NO: 3401921 - protein, 4 aa, Plasmodium falciparum
RPNN

SEQ ID NO: 3401922 - protein, 7 aa, Plasmodium falciparum
RPNSPNE

SEQ ID NO: 3401923 - protein, 4 aa, Plasmodium falciparum
RPPY

SEQ ID NO: 3401924 - protein, 7 aa, Plasmodium falciparum
RPRQRMT

SEQ ID NO: 3401925 - protein, 4 aa, Plasmodium falciparum
RQDP

SEQ ID NO: 3401926 - protein, 4 aa, Plasmodium falciparum
RQEC

SEQ ID NO: 3401927 - protein, 5 aa, Plasmodium falciparum
RQEDD

SEQ ID NO: 3401928 - protein, 8 aa, Plasmodium falciparum
RRDNHKKK

SEQ ID NO: 3401929 - protein, 10 aa, Plasmodium falciparum
RRDTEKKKKW

SEQ ID NO: 3401930 - protein, 7 aa, Plasmodium falciparum
RREREYE

SEQ ID NO: 3401931 - protein, 5 aa, Plasmodium falciparum
RRGEK

SEQ ID NO: 3401932 - protein, 4 aa, Plasmodium falciparum
RRKE

SEQ ID NO: 3401933 - protein, 5 aa, Plasmodium falciparum
RRPSN

SEQ ID NO: 3401934 - protein, 17 aa, Plasmodium falciparum
RRSEIKKDRQKRIKYED

SEQ ID NO: 3401935 - protein, 8 aa, Plasmodium falciparum
RRSNQNNE

SEQ ID NO: 3401936 - protein, 11 aa, Plasmodium falciparum
RRYDPNKSKTF

SEQ ID NO: 3401937 - protein, 9 aa, Plasmodium falciparum
RSDEKDTTD

SEQ ID NO: 3401938 - protein, 7 aa, Plasmodium falciparum
RSDPNRQ

SEQ ID NO: 3401939 - protein, 7 aa, Plasmodium falciparum
RSENKNS

SEQ ID NO: 3401940 - protein, 6 aa, Plasmodium falciparum
RSEQYS

SEQ ID NO: 3401941 - protein, 6 aa, Plasmodium falciparum
RSGDNM

SEQ ID NO: 3401942 - protein, 11 aa, Plasmodium falciparum
RSHNNTGYGGL

SEQ ID NO: 3401943 - protein, 24 aa, Plasmodium falciparum
RSKISKKKRKDKTPKDANKKNEDA

SEQ ID NO: 3401944 - protein, 8 aa, Plasmodium falciparum
RSKNNENL

SEQ ID NO: 3401945 - protein, 14 aa, Plasmodium falciparum
RSKTFSLDDPQKNS

SEQ ID NO: 3401946 - protein, 9 aa, Plasmodium falciparum
RSNKNRESH

SEQ ID NO: 3401947 - protein, 8 aa, Plasmodium falciparum
RSNQTTKD

SEQ ID NO: 3401948 - protein, 4 aa, Plasmodium falciparum
RSSR

SEQ ID NO: 3401949 - protein, 17 aa, Plasmodium falciparum
RSSSLSPFNTNENSNSD

SEQ ID NO: 3401950 - protein, 7 aa, Plasmodium falciparum
RSSSNSI

SEQ ID NO: 3401951 - protein, 9 aa, Plasmodium falciparum
RSSSQQKDI

SEQ ID NO: 3401952 - protein, 9 aa, Plasmodium falciparum
RSTPKKEHT

SEQ ID NO: 3401953 - protein, 7 aa, Plasmodium falciparum
RSVPEEK

SEQ ID NO: 3401954 - protein, 12 aa, Plasmodium falciparum
RSYSSNPEKQEG

SEQ ID NO: 3401955 - protein, 7 aa, Plasmodium falciparum
RTDKGVH

SEQ ID NO: 3401956 - protein, 6 aa, Plasmodium falciparum
RTDKYG

SEQ ID NO: 3401957 - protein, 8 aa, Plasmodium falciparum
RTKKSEKI

SEQ ID NO: 3401958 - protein, 5 aa, Plasmodium falciparum
RTKNN

SEQ ID NO: 3401959 - protein, 4 aa, Plasmodium falciparum
RTNH

SEQ ID NO: 3401960 - protein, 11 aa, Plasmodium falciparum
RTQNTFNNDEY

SEQ ID NO: 3401961 - protein, 4 aa, Plasmodium falciparum
RTSL

SEQ ID NO: 3401962 - protein, 5 aa, Plasmodium falciparum
RTSND

SEQ ID NO: 3401963 - protein, 5 aa, Plasmodium falciparum
RTSWD

SEQ ID NO: 3401964 - protein, 4 aa, Plasmodium falciparum
RVTE

SEQ ID NO: 3401965 - protein, 4 aa, Plasmodium falciparum
RYEK

SEQ ID NO: 3401966 - protein, 9 aa, Plasmodium falciparum
RYKNQGGIS

SEQ ID NO: 3401967 - protein, 12 aa, Plasmodium falciparum
RYPEGRHAPITD

SEQ ID NO: 3401968 - protein, 5 aa, Plasmodium falciparum
SADSN

SEQ ID NO: 3401969 - protein, 25 aa, Plasmodium falciparum
SAEKKNKELPEEKKELQKNSEKNIN

SEQ ID NO: 3401970 - protein, 9 aa, Plasmodium falciparum
SAENKNESS

SEQ ID NO: 3401971 - protein, 28 aa, Plasmodium falciparum
SAIYTPNEKINESQEVSTIEDEEEKEEI

SEQ ID NO: 3401972 - protein, 5 aa, Plasmodium falciparum
SAKRE

SEQ ID NO: 3401973 - protein, 6 aa, Plasmodium falciparum
SAMSNE

SEQ ID NO: 3401974 - protein, 8 aa, Plasmodium falciparum
SANNGNEY

SEQ ID NO: 3401975 - protein, 17 aa, Plasmodium falciparum
SANNSANNGKKNNAEEM

SEQ ID NO: 3401976 - protein, 49 aa, Plasmodium falciparum
SANSVSDSSNSSYQNNKNNNNNNDNNNNNYNNNNNNNSKNKKKNNSVQY

SEQ ID NO: 3401977 - protein, 5 aa, Plasmodium falciparum
SAPKK

SEQ ID NO: 3401978 - protein, 6 aa, Plasmodium falciparum
SASTGY

SEQ ID NO: 3401979 - protein, 7 aa, Plasmodium falciparum
SATKRRN

SEQ ID NO: 3401980 - protein, 7 aa, Plasmodium falciparum
SCGEPEN

SEQ ID NO: 3401981 - protein, 4 aa, Plasmodium falciparum
SCGK

SEQ ID NO: 3401982 - protein, 8 aa, Plasmodium falciparum
SCGNGERD

SEQ ID NO: 3401983 - protein, 18 aa, Plasmodium falciparum
SCKNESRNIYTHSVYVQN

SEQ ID NO: 3401984 - protein, 5 aa, Plasmodium falciparum
SCPSG

SEQ ID NO: 3401985 - protein, 4 aa, Plasmodium falciparum
SCQT

SEQ ID NO: 3401986 - protein, 7 aa, Plasmodium falciparum
SDALGED

SEQ ID NO: 3401987 - protein, 9 aa, Plasmodium falciparum
SDDETGNIS

SEQ ID NO: 3401988 - protein, 7 aa, Plasmodium falciparum
SDDGNNI

SEQ ID NO: 3401989 - protein, 43 aa, Plasmodium falciparum
SDDHSNKNDINKKTEKNKTFNSSSTSDEKKQTDIKGQNKNDLN

SEQ ID NO: 3401990 - protein, 8 aa, Plasmodium falciparum
SDDKKKKQ

SEQ ID NO: 3401991 - protein, 12 aa, Plasmodium falciparum
SDDKNDKVNRDE

SEQ ID NO: 3401992 - protein, 19 aa, Plasmodium falciparum
SDDLNKTQKEELSIKDETN

SEQ ID NO: 3401993 - protein, 13 aa, Plasmodium falciparum
SDDNHNNNNNNNN

SEQ ID NO: 3401994 - protein, 24 aa, Plasmodium falciparum
SDDNISEDDAPRRKKEKIKENKEI

SEQ ID NO: 3401995 - protein, 4 aa, Plasmodium falciparum
SDDS

SEQ ID NO: 3401996 - protein, 7 aa, Plasmodium falciparum
SDDSQKN

SEQ ID NO: 3401997 - protein, 8 aa, Plasmodium falciparum
SDEDNHQS

SEQ ID NO: 3401998 - protein, 6 aa, Plasmodium falciparum
SDEGKQ

SEQ ID NO: 3401999 - protein, 7 aa, Plasmodium falciparum
SDENSNG

SEQ ID NO: 3402000 - protein, 8 aa, Plasmodium falciparum
SDERKIGE

SEQ ID NO: 3402001 - protein, 9 aa, Plasmodium falciparum
SDGNSSFTE

SEQ ID NO: 3402002 - protein, 9 aa, Plasmodium falciparum
SDGSEGCAK

SEQ ID NO: 3402003 - protein, 9 aa, Plasmodium falciparum
SDHNNGNQY

SEQ ID NO: 3402004 - protein, 6 aa, Plasmodium falciparum
SDIPED

SEQ ID NO: 3402005 - protein, 13 aa, Plasmodium falciparum
SDIQEKIDKNEKI

SEQ ID NO: 3402006 - protein, 20 aa, Plasmodium falciparum
SDKEKKKDVPTNDDNKNATV

SEQ ID NO: 3402007 - protein, 13 aa, Plasmodium falciparum
SDKSSTKANEEWG

SEQ ID NO: 3402008 - protein, 10 aa, Plasmodium falciparum
SDLAKSGTNH

SEQ ID NO: 3402009 - protein, 6 aa, Plasmodium falciparum
SDLENT

SEQ ID NO: 3402010 - protein, 7 aa, Plasmodium falciparum
SDMNNNK

SEQ ID NO: 3402011 - protein, 8 aa, Plasmodium falciparum
SDNAAHNE

SEQ ID NO: 3402012 - protein, 8 aa, Plasmodium falciparum
SDNEDKCN

SEQ ID NO: 3402013 - protein, 12 aa, Plasmodium falciparum
SDNEIGKKGEVK

SEQ ID NO: 3402014 - protein, 10 aa, Plasmodium falciparum
SDNHVDNNKN

SEQ ID NO: 3402015 - protein, 6 aa, Plasmodium falciparum
SDNNSY

SEQ ID NO: 3402016 - protein, 5 aa, Plasmodium falciparum
SDPPK

SEQ ID NO: 3402017 - protein, 6 aa, Plasmodium falciparum
SDRDSD

SEQ ID NO: 3402018 - protein, 13 aa, Plasmodium falciparum
SDSAYKPDLNIWT

SEQ ID NO: 3402019 - protein, 13 aa, Plasmodium falciparum
SDSFDSDDLKESY

SEQ ID NO: 3402020 - protein, 15 aa, Plasmodium falciparum
SDSIQKSKTTLDDKK

SEQ ID NO: 3402021 - protein, 4 aa, Plasmodium falciparum
SDSN

SEQ ID NO: 3402022 - protein, 10 aa, Plasmodium falciparum
SDTIEGTSKD

SEQ ID NO: 3402023 - protein, 4 aa, Plasmodium falciparum
SDVG

SEQ ID NO: 3402024 - protein, 16 aa, Plasmodium falciparum
SDYTKSLSAEAKVSGS

SEQ ID NO: 3402025 - protein, 6 aa, Plasmodium falciparum
SEASSP

SEQ ID NO: 3402026 - protein, 9 aa, Plasmodium falciparum
SEDMENGEE

SEQ ID NO: 3402027 - protein, 5 aa, Plasmodium falciparum
SEDND

SEQ ID NO: 3402028 - protein, 8 aa, Plasmodium falciparum
SEDVEASI

SEQ ID NO: 3402029 - protein, 4 aa, Plasmodium falciparum
SEEE

SEQ ID NO: 3402030 - protein, 6 aa, Plasmodium falciparum
SEEEDS

SEQ ID NO: 3402031 - protein, 5 aa, Plasmodium falciparum
SEEGQ

SEQ ID NO: 3402032 - protein, 11 aa, Plasmodium falciparum
SEEIKTNKITN

SEQ ID NO: 3402033 - protein, 20 aa, Plasmodium falciparum
SEEKAKFDEAIAETKRMKAL

SEQ ID NO: 3402034 - protein, 20 aa, Plasmodium falciparum
SEESNPEPAENEESSIEEAH

SEQ ID NO: 3402035 - protein, 6 aa, Plasmodium falciparum
SEESVE

SEQ ID NO: 3402036 - protein, 5 aa, Plasmodium falciparum
SEEYN

SEQ ID NO: 3402037 - protein, 9 aa, Plasmodium falciparum
SEGDKATFE

SEQ ID NO: 3402038 - protein, 5 aa, Plasmodium falciparum
SEGDS

SEQ ID NO: 3402039 - protein, 10 aa, Plasmodium falciparum
SEGVESQSET

SEQ ID NO: 3402040 - protein, 5 aa, Plasmodium falciparum
SEIPE

SEQ ID NO: 3402041 - protein, 5 aa, Plasmodium falciparum
SEISK

SEQ ID NO: 3402042 - protein, 4 aa, Plasmodium falciparum
SEKE

SEQ ID NO: 3402043 - protein, 10 aa, Plasmodium falciparum
SEKKEDINSY

SEQ ID NO: 3402044 - protein, 14 aa, Plasmodium falciparum
SEKKEKNKNKESHG

SEQ ID NO: 3402045 - protein, 15 aa, Plasmodium falciparum
SEKKERKKVQDPYDL

SEQ ID NO: 3402046 - protein, 11 aa, Plasmodium falciparum
SEKKKDTEVAS

SEQ ID NO: 3402047 - protein, 10 aa, Plasmodium falciparum
SEKKNKSYSS

SEQ ID NO: 3402048 - protein, 6 aa, Plasmodium falciparum
SEKNLE

SEQ ID NO: 3402049 - protein, 5 aa, Plasmodium falciparum
SENDE

SEQ ID NO: 3402050 - protein, 10 aa, Plasmodium falciparum
SENEEEDDIN

SEQ ID NO: 3402051 - protein, 13 aa, Plasmodium falciparum
SENEYKKNNDENI

SEQ ID NO: 3402052 - protein, 14 aa, Plasmodium falciparum
SENFEYSESEEKFI

SEQ ID NO: 3402053 - protein, 6 aa, Plasmodium falciparum
SENNST

SEQ ID NO: 3402054 - protein, 11 aa, Plasmodium falciparum
SENSNSGSSNW

SEQ ID NO: 3402055 - protein, 4 aa, Plasmodium falciparum
SENV

SEQ ID NO: 3402056 - protein, 12 aa, Plasmodium falciparum
SENYKTNQKDEA

SEQ ID NO: 3402057 - protein, 26 aa, Plasmodium falciparum
SEQDNMNNKENKNNKDHKNNQNDKNI

SEQ ID NO: 3402058 - protein, 4 aa, Plasmodium falciparum
SEQI

SEQ ID NO: 3402059 - protein, 8 aa, Plasmodium falciparum
SEQNYNED

SEQ ID NO: 3402060 - protein, 8 aa, Plasmodium falciparum
SERKETNM

SEQ ID NO: 3402061 - protein, 6 aa, Plasmodium falciparum
SERQNV

SEQ ID NO: 3402062 - protein, 12 aa, Plasmodium falciparum
SESNNNKNGGDN

SEQ ID NO: 3402063 - protein, 19 aa, Plasmodium falciparum
SESPDSTKVRQTAGISYDD

SEQ ID NO: 3402064 - protein, 8 aa, Plasmodium falciparum
SESTSTYN

SEQ ID NO: 3402065 - protein, 6 aa, Plasmodium falciparum
SEYADT

SEQ ID NO: 3402066 - protein, 5 aa, Plasmodium falciparum
SEYDL

SEQ ID NO: 3402067 - protein, 5 aa, Plasmodium falciparum
SEYGE

SEQ ID NO: 3402068 - protein, 37 aa, Plasmodium falciparum
SFEQSRNQQSSPVTPKRNGISPTNAKSPESVLPPAQS

SEQ ID NO: 3402069 - protein, 5 aa, Plasmodium falciparum
SFESA

SEQ ID NO: 3402070 - protein, 9 aa, Plasmodium falciparum
SFSEYPPEF

SEQ ID NO: 3402071 - protein, 8 aa, Plasmodium falciparum
SFSSSREN

SEQ ID NO: 3402072 - protein, 4 aa, Plasmodium falciparum
SGGI

SEQ ID NO: 3402073 - protein, 11 aa, Plasmodium falciparum
SGGNTIYEEPK

SEQ ID NO: 3402074 - protein, 6 aa, Plasmodium falciparum
SGGPSF

SEQ ID NO: 3402075 - protein, 12 aa, Plasmodium falciparum
SGGRDRKGADGK

SEQ ID NO: 3402076 - protein, 4 aa, Plasmodium falciparum
SGHF

SEQ ID NO: 3402077 - protein, 4 aa, Plasmodium falciparum
SGID

SEQ ID NO: 3402078 - protein, 7 aa, Plasmodium falciparum
SGKSTLA

SEQ ID NO: 3402079 - protein, 10 aa, Plasmodium falciparum
SGNKKPHTAI

SEQ ID NO: 3402080 - protein, 25 aa, Plasmodium falciparum
SGQKYGPNKGLPNDKSKNKIKEPHN

SEQ ID NO: 3402081 - protein, 6 aa, Plasmodium falciparum
SGSGNV

SEQ ID NO: 3402082 - protein, 11 aa, Plasmodium falciparum
SGTSGKPKGAM

SEQ ID NO: 3402083 - protein, 9 aa, Plasmodium falciparum
SGTSGQPKG

SEQ ID NO: 3402084 - protein, 5 aa, Plasmodium falciparum
SGTSP

SEQ ID NO: 3402085 - protein, 45 aa, Plasmodium falciparum
SGTVDSDVSRTDSTGNVNSKNSELSETRQNSVEQNNNSNSSDNSI

SEQ ID NO: 3402086 - protein, 6 aa, Plasmodium falciparum
SGTYKG

SEQ ID NO: 3402087 - protein, 6 aa, Plasmodium falciparum
SGVPKN

SEQ ID NO: 3402088 - protein, 7 aa, Plasmodium falciparum
SGYGSSV

SEQ ID NO: 3402089 - protein, 7 aa, Plasmodium falciparum
SHDTRRH

SEQ ID NO: 3402090 - protein, 4 aa, Plasmodium falciparum
SHDY

SEQ ID NO: 3402091 - protein, 56 aa, Plasmodium falciparum
SHNDYQKNNKGNHKGNNKSNNKSNDKDSNNNSNNNSNKNGNNHNDNNNNNQNKDID

SEQ ID NO: 3402092 - protein, 12 aa, Plasmodium falciparum
SHNNNNNNNNDS

SEQ ID NO: 3402093 - protein, 8 aa, Plasmodium falciparum
SHTNYSNK

SEQ ID NO: 3402094 - protein, 6 aa, Plasmodium falciparum
SIDEKE

SEQ ID NO: 3402095 - protein, 8 aa, Plasmodium falciparum
SIENSDID

SEQ ID NO: 3402096 - protein, 7 aa, Plasmodium falciparum
SIHPSST

SEQ ID NO: 3402097 - protein, 9 aa, Plasmodium falciparum
SIKSGESYV

SEQ ID NO: 3402098 - protein, 4 aa, Plasmodium falciparum
SIKT

SEQ ID NO: 3402099 - protein, 7 aa, Plasmodium falciparum
SISEKDM

SEQ ID NO: 3402100 - protein, 8 aa, Plasmodium falciparum
SISGSVGT

SEQ ID NO: 3402101 - protein, 12 aa, Plasmodium falciparum
SISSDKIKKKEE

SEQ ID NO: 3402102 - protein, 5 aa, Plasmodium falciparum
SITDD

SEQ ID NO: 3402103 - protein, 5 aa, Plasmodium falciparum
SIYGE

SEQ ID NO: 3402104 - protein, 6 aa, Plasmodium falciparum
SKAEKY

SEQ ID NO: 3402105 - protein, 8 aa, Plasmodium falciparum
SKANEQDY

SEQ ID NO: 3402106 - protein, 6 aa, Plasmodium falciparum
SKCNDI

SEQ ID NO: 3402107 - protein, 7 aa, Plasmodium falciparum
SKDEEDI

SEQ ID NO: 3402108 - protein, 8 aa, Plasmodium falciparum
SKDGSGND

SEQ ID NO: 3402109 - protein, 82 aa, Plasmodium falciparum
SKDKENISKENDDVLDEKEEEAEETEEEELEEKNEEETESEISEDEEEEEEEEEKEEENDKKKEQEKEQSNENNDQKKDMEA

SEQ ID NO: 3402110 - protein, 8 aa, Plasmodium falciparum
SKDKTYSN

SEQ ID NO: 3402111 - protein, 8 aa, Plasmodium falciparum
SKDNKQDI

SEQ ID NO: 3402112 - protein, 8 aa, Plasmodium falciparum
SKDNTISE

SEQ ID NO: 3402113 - protein, 11 aa, Plasmodium falciparum
SKEENRSEIAQ

SEQ ID NO: 3402114 - protein, 13 aa, Plasmodium falciparum
SKEEQSKLEETTE

SEQ ID NO: 3402115 - protein, 7 aa, Plasmodium falciparum
SKEGNSL

SEQ ID NO: 3402116 - protein, 26 aa, Plasmodium falciparum
SKENREEPGTSGTTSGANGNKANIPD

SEQ ID NO: 3402117 - protein, 7 aa, Plasmodium falciparum
SKGEYSK

SEQ ID NO: 3402118 - protein, 5 aa, Plasmodium falciparum
SKGKA

SEQ ID NO: 3402119 - protein, 8 aa, Plasmodium falciparum
SKHKDNDK

SEQ ID NO: 3402120 - protein, 11 aa, Plasmodium falciparum
SKHKKFNRNYS

SEQ ID NO: 3402121 - protein, 10 aa, Plasmodium falciparum
SKIDNSSVSI

SEQ ID NO: 3402122 - protein, 5 aa, Plasmodium falciparum
SKIPY

SEQ ID NO: 3402123 - protein, 5 aa, Plasmodium falciparum
SKIQR

SEQ ID NO: 3402124 - protein, 8 aa, Plasmodium falciparum
SKKDMQGN

SEQ ID NO: 3402125 - protein, 9 aa, Plasmodium falciparum
SKKEENDDI

SEQ ID NO: 3402126 - protein, 9 aa, Plasmodium falciparum
SKKKKNGHH

SEQ ID NO: 3402127 - protein, 15 aa, Plasmodium falciparum
SKKKKNNNGKSIESH

SEQ ID NO: 3402128 - protein, 10 aa, Plasmodium falciparum
SKKKSKQCKS

SEQ ID NO: 3402129 - protein, 7 aa, Plasmodium falciparum
SKKLSRD

SEQ ID NO: 3402130 - protein, 16 aa, Plasmodium falciparum
SKKNIIEGSPQEEESF

SEQ ID NO: 3402131 - protein, 9 aa, Plasmodium falciparum
SKKPMGELK

SEQ ID NO: 3402132 - protein, 4 aa, Plasmodium falciparum
SKKY

SEQ ID NO: 3402133 - protein, 6 aa, Plasmodium falciparum
SKNCAE

SEQ ID NO: 3402134 - protein, 6 aa, Plasmodium falciparum
SKNDKV

SEQ ID NO: 3402135 - protein, 4 aa, Plasmodium falciparum
SKNE

SEQ ID NO: 3402136 - protein, 15 aa, Plasmodium falciparum
SKNEKKDVCTEGSNP

SEQ ID NO: 3402137 - protein, 10 aa, Plasmodium falciparum
SKNEKKKRKK

SEQ ID NO: 3402138 - protein, 5 aa, Plasmodium falciparum
SKNET

SEQ ID NO: 3402139 - protein, 10 aa, Plasmodium falciparum
SKNKKEEKKE

SEQ ID NO: 3402140 - protein, 8 aa, Plasmodium falciparum
SKNKNEPE

SEQ ID NO: 3402141 - protein, 4 aa, Plasmodium falciparum
SKNN

SEQ ID NO: 3402142 - protein, 10 aa, Plasmodium falciparum
SKNNDKVTDG

SEQ ID NO: 3402143 - protein, 8 aa, Plasmodium falciparum
SKNNEDNI

SEQ ID NO: 3402144 - protein, 8 aa, Plasmodium falciparum
SKNNSNIN

SEQ ID NO: 3402145 - protein, 11 aa, Plasmodium falciparum
SKNSDNEKYRS

SEQ ID NO: 3402146 - protein, 8 aa, Plasmodium falciparum
SKNSYDKG

SEQ ID NO: 3402147 - protein, 15 aa, Plasmodium falciparum
SKQDKERKKSHYNNK

SEQ ID NO: 3402148 - protein, 8 aa, Plasmodium falciparum
SKQNVNKP

SEQ ID NO: 3402149 - protein, 4 aa, Plasmodium falciparum
SKRK

SEQ ID NO: 3402150 - protein, 7 aa, Plasmodium falciparum
SKRKITN

SEQ ID NO: 3402151 - protein, 12 aa, Plasmodium falciparum
SKRQQKLKGDKI

SEQ ID NO: 3402152 - protein, 7 aa, Plasmodium falciparum
SKSGGDM

SEQ ID NO: 3402153 - protein, 13 aa, Plasmodium falciparum
SKSKISNRSNKLN

SEQ ID NO: 3402154 - protein, 5 aa, Plasmodium falciparum
SKSSY

SEQ ID NO: 3402155 - protein, 20 aa, Plasmodium falciparum
SKSYGTFKEENDQKKKKNRW

SEQ ID NO: 3402156 - protein, 13 aa, Plasmodium falciparum
SKTEDDNKKGNRG

SEQ ID NO: 3402157 - protein, 6 aa, Plasmodium falciparum
SKTIPS

SEQ ID NO: 3402158 - protein, 4 aa, Plasmodium falciparum
SKTN

SEQ ID NO: 3402159 - protein, 11 aa, Plasmodium falciparum
SKTNEEEEGKI

SEQ ID NO: 3402160 - protein, 7 aa, Plasmodium falciparum
SKTTDHS

SEQ ID NO: 3402161 - protein, 8 aa, Plasmodium falciparum
SKTYSEKK

SEQ ID NO: 3402162 - protein, 7 aa, Plasmodium falciparum
SKVEEKN

SEQ ID NO: 3402163 - protein, 4 aa, Plasmodium falciparum
SKYN

SEQ ID NO: 3402164 - protein, 16 aa, Plasmodium falciparum
SLDEEDELSDAEHYND

SEQ ID NO: 3402165 - protein, 6 aa, Plasmodium falciparum
SLDEEF

SEQ ID NO: 3402166 - protein, 7 aa, Plasmodium falciparum
SLDRKTK

SEQ ID NO: 3402167 - protein, 11 aa, Plasmodium falciparum
SLESAEEEATV

SEQ ID NO: 3402168 - protein, 37 aa, Plasmodium falciparum
SLGEKKKRRKGRGVGSKRGGSCGRGMKGQKSRSGGSI

SEQ ID NO: 3402169 - protein, 7 aa, Plasmodium falciparum
SLKETNE

SEQ ID NO: 3402170 - protein, 8 aa, Plasmodium falciparum
SLNEKVNE

SEQ ID NO: 3402171 - protein, 12 aa, Plasmodium falciparum
SLNNEGGFSNTY

SEQ ID NO: 3402172 - protein, 8 aa, Plasmodium falciparum
SLPNGSKS

SEQ ID NO: 3402173 - protein, 7 aa, Plasmodium falciparum
SLPTHPV

SEQ ID NO: 3402174 - protein, 6 aa, Plasmodium falciparum
SLPVRK

SEQ ID NO: 3402175 - protein, 15 aa, Plasmodium falciparum
SLRKNYKRELQKKSE

SEQ ID NO: 3402176 - protein, 9 aa, Plasmodium falciparum
SLRRRSQIK

SEQ ID NO: 3402177 - protein, 7 aa, Plasmodium falciparum
SLSDTGN

SEQ ID NO: 3402178 - protein, 17 aa, Plasmodium falciparum
SLSGEKSDKENEQHENE

SEQ ID NO: 3402179 - protein, 26 aa, Plasmodium falciparum
SMEKKGNISQQKNEQDDQGDDECGNS

SEQ ID NO: 3402180 - protein, 29 aa, Plasmodium falciparum
SMNYNEGDATDKNNNSNNNNVESANDSTN

SEQ ID NO: 3402181 - protein, 8 aa, Plasmodium falciparum
SMPSSPNP

SEQ ID NO: 3402182 - protein, 12 aa, Plasmodium falciparum
SNANKDKEKAYT

SEQ ID NO: 3402183 - protein, 15 aa, Plasmodium falciparum
SNDCISPNNTESYNT

SEQ ID NO: 3402184 - protein, 4 aa, Plasmodium falciparum
SNDI

SEQ ID NO: 3402185 - protein, 8 aa, Plasmodium falciparum
SNDITNDK

SEQ ID NO: 3402186 - protein, 5 aa, Plasmodium falciparum
SNDLT

SEQ ID NO: 3402187 - protein, 10 aa, Plasmodium falciparum
SNDNHTSDNE

SEQ ID NO: 3402188 - protein, 9 aa, Plasmodium falciparum
SNDPKGTIQ

SEQ ID NO: 3402189 - protein, 8 aa, Plasmodium falciparum
SNDSNSVT

SEQ ID NO: 3402190 - protein, 8 aa, Plasmodium falciparum
SNDTINEN

SEQ ID NO: 3402191 - protein, 7 aa, Plasmodium falciparum
SNDTRQL

SEQ ID NO: 3402192 - protein, 4 aa, Plasmodium falciparum
SNEG

SEQ ID NO: 3402193 - protein, 11 aa, Plasmodium falciparum
SNEGNNRNTIN

SEQ ID NO: 3402194 - protein, 9 aa, Plasmodium falciparum
SNEKKKKTH

SEQ ID NO: 3402195 - protein, 10 aa, Plasmodium falciparum
SNEKNECEKH

SEQ ID NO: 3402196 - protein, 19 aa, Plasmodium falciparum
SNENGDNTFNNNNNNMDNK

SEQ ID NO: 3402197 - protein, 7 aa, Plasmodium falciparum
SNENGNL

SEQ ID NO: 3402198 - protein, 10 aa, Plasmodium falciparum
SNGVFSKQQK

SEQ ID NO: 3402199 - protein, 9 aa, Plasmodium falciparum
SNHEKPNTK

SEQ ID NO: 3402200 - protein, 9 aa, Plasmodium falciparum
SNHNYRSNN

SEQ ID NO: 3402201 - protein, 6 aa, Plasmodium falciparum
SNIAEE

SEQ ID NO: 3402202 - protein, 5 aa, Plasmodium falciparum
SNIEG

SEQ ID NO: 3402203 - protein, 21 aa, Plasmodium falciparum
SNIGGNEVDADENSFNPDTEV

SEQ ID NO: 3402204 - protein, 43 aa, Plasmodium falciparum
SNKDIKSSSQNSSIKAQNSSTKIGNTPTKLSTQNTKSNSTSNQ

SEQ ID NO: 3402205 - protein, 17 aa, Plasmodium falciparum
SNKFSSSSLQNNTTNNN

SEQ ID NO: 3402206 - protein, 4 aa, Plasmodium falciparum
SNKK

SEQ ID NO: 3402207 - protein, 7 aa, Plasmodium falciparum
SNKKETL

SEQ ID NO: 3402208 - protein, 7 aa, Plasmodium falciparum
SNKKKVA

SEQ ID NO: 3402209 - protein, 11 aa, Plasmodium falciparum
SNKKSLNKNKI

SEQ ID NO: 3402210 - protein, 5 aa, Plasmodium falciparum
SNKKY

SEQ ID NO: 3402211 - protein, 4 aa, Plasmodium falciparum
SNKN

SEQ ID NO: 3402212 - protein, 9 aa, Plasmodium falciparum
SNKNTIKEG

SEQ ID NO: 3402213 - protein, 5 aa, Plasmodium falciparum
SNKSA

SEQ ID NO: 3402214 - protein, 11 aa, Plasmodium falciparum
SNMNDNSNKSC

SEQ ID NO: 3402215 - protein, 10 aa, Plasmodium falciparum
SNMSKDVNKT

SEQ ID NO: 3402216 - protein, 8 aa, Plasmodium falciparum
SNNDNNNL

SEQ ID NO: 3402217 - protein, 16 aa, Plasmodium falciparum
SNNDTNSNGSTNIDSS

SEQ ID NO: 3402218 - protein, 22 aa, Plasmodium falciparum
SNNIKNSDKNSSLTKNQDSDNM

SEQ ID NO: 3402219 - protein, 8 aa, Plasmodium falciparum
SNNIRKDE

SEQ ID NO: 3402220 - protein, 27 aa, Plasmodium falciparum
SNNISGPNNISSERSQNNMKDDQINYQ

SEQ ID NO: 3402221 - protein, 30 aa, Plasmodium falciparum
SNNKKGKNSKKKSDLKNSRFESTQNNNNIL

SEQ ID NO: 3402222 - protein, 4 aa, Plasmodium falciparum
SNNN

SEQ ID NO: 3402223 - protein, 8 aa, Plasmodium falciparum
SNNNNQNV

SEQ ID NO: 3402224 - protein, 4 aa, Plasmodium falciparum
SNNQ

SEQ ID NO: 3402225 - protein, 23 aa, Plasmodium falciparum
SNNTNSDSNVKNTSMGNGQNKYD

SEQ ID NO: 3402226 - protein, 4 aa, Plasmodium falciparum
SNNY

SEQ ID NO: 3402227 - protein, 14 aa, Plasmodium falciparum
SNNYNRDDEITPFN

SEQ ID NO: 3402228 - protein, 9 aa, Plasmodium falciparum
SNPSPIKKT

SEQ ID NO: 3402229 - protein, 5 aa, Plasmodium falciparum
SNQKE

SEQ ID NO: 3402230 - protein, 10 aa, Plasmodium falciparum
SNRENKMNSE

SEQ ID NO: 3402231 - protein, 9 aa, Plasmodium falciparum
SNSDQIKAM

SEQ ID NO: 3402232 - protein, 11 aa, Plasmodium falciparum
SNSGKSSLDTS

SEQ ID NO: 3402233 - protein, 6 aa, Plasmodium falciparum
SNSHNS

SEQ ID NO: 3402234 - protein, 7 aa, Plasmodium falciparum
SNSKKGF

SEQ ID NO: 3402235 - protein, 9 aa, Plasmodium falciparum
SNSQQKKRE

SEQ ID NO: 3402236 - protein, 9 aa, Plasmodium falciparum
SNSSNTKGW

SEQ ID NO: 3402237 - protein, 23 aa, Plasmodium falciparum
SNTKKDKKKNQKNKKGVQKTIDG

SEQ ID NO: 3402238 - protein, 12 aa, Plasmodium falciparum
SNTVQGATGIPG

SEQ ID NO: 3402239 - protein, 4 aa, Plasmodium falciparum
SNTY

SEQ ID NO: 3402240 - protein, 4 aa, Plasmodium falciparum
SNVQ

SEQ ID NO: 3402241 - protein, 9 aa, Plasmodium falciparum
SNYETDERG

SEQ ID NO: 3402242 - protein, 13 aa, Plasmodium falciparum
SNYETEQNNDDIK

SEQ ID NO: 3402243 - protein, 7 aa, Plasmodium falciparum
SNYKKKG

SEQ ID NO: 3402244 - protein, 4 aa, Plasmodium falciparum
SNYP

SEQ ID NO: 3402245 - protein, 4 aa, Plasmodium falciparum
SNYS

SEQ ID NO: 3402246 - protein, 16 aa, Plasmodium falciparum
SPDVSESEESLSDDFF

SEQ ID NO: 3402247 - protein, 18 aa, Plasmodium falciparum
SPEQVRQKTNTPNKKVAN

SEQ ID NO: 3402248 - protein, 7 aa, Plasmodium falciparum
SPFSEEQ

SEQ ID NO: 3402249 - protein, 4 aa, Plasmodium falciparum
SPGK

SEQ ID NO: 3402250 - protein, 5 aa, Plasmodium falciparum
SPINE

SEQ ID NO: 3402251 - protein, 11 aa, Plasmodium falciparum
SPKRKKTVVQK

SEQ ID NO: 3402252 - protein, 5 aa, Plasmodium falciparum
SPKSH

SEQ ID NO: 3402253 - protein, 4 aa, Plasmodium falciparum
SPLD

SEQ ID NO: 3402254 - protein, 9 aa, Plasmodium falciparum
SPLKNDLSE

SEQ ID NO: 3402255 - protein, 12 aa, Plasmodium falciparum
SPLQGNHNKCPD

SEQ ID NO: 3402256 - protein, 9 aa, Plasmodium falciparum
SPLSSADSL

SEQ ID NO: 3402257 - protein, 6 aa, Plasmodium falciparum
SPLTSN

SEQ ID NO: 3402258 - protein, 6 aa, Plasmodium falciparum
SPNGES

SEQ ID NO: 3402259 - protein, 9 aa, Plasmodium falciparum
SPNKNEKSE

SEQ ID NO: 3402260 - protein, 6 aa, Plasmodium falciparum
SPNKTI

SEQ ID NO: 3402261 - protein, 10 aa, Plasmodium falciparum
SPPENPLPQV

SEQ ID NO: 3402262 - protein, 4 aa, Plasmodium falciparum
SPPI

SEQ ID NO: 3402263 - protein, 12 aa, Plasmodium falciparum
SPRISEEEIKES

SEQ ID NO: 3402264 - protein, 28 aa, Plasmodium falciparum
SPSTDMKKTTSQGSLSNDSNENIKKTNK

SEQ ID NO: 3402265 - protein, 6 aa, Plasmodium falciparum
SPSTRY

SEQ ID NO: 3402266 - protein, 7 aa, Plasmodium falciparum
SPTRAEV

SEQ ID NO: 3402267 - protein, 4 aa, Plasmodium falciparum
SPYV

SEQ ID NO: 3402268 - protein, 16 aa, Plasmodium falciparum
SQDNYESKLKKNEDDI

SEQ ID NO: 3402269 - protein, 6 aa, Plasmodium falciparum
SQENYY

SEQ ID NO: 3402270 - protein, 8 aa, Plasmodium falciparum
SQEQPNHT

SEQ ID NO: 3402271 - protein, 6 aa, Plasmodium falciparum
SQEQYF

SEQ ID NO: 3402272 - protein, 23 aa, Plasmodium falciparum
SQFDNNKKNKMSVSTHNKKSKNL

SEQ ID NO: 3402273 - protein, 10 aa, Plasmodium falciparum
SQGGGGKGIR

SEQ ID NO: 3402274 - protein, 79 aa, Plasmodium falciparum
SQGHKKETSQNQNENNDNQKYQEVNDEDDVNDEEDTNDDEDTNDEEDTNDDEDTNDDEDTNDEEDTNDEEDHENNNATA

SEQ ID NO: 3402275 - protein, 5 aa, Plasmodium falciparum
SQGNF

SEQ ID NO: 3402276 - protein, 7 aa, Plasmodium falciparum
SQINKQN

SEQ ID NO: 3402277 - protein, 9 aa, Plasmodium falciparum
SQKYQNGKN

SEQ ID NO: 3402278 - protein, 24 aa, Plasmodium falciparum
SQNENANINEQNRKNINENANLEN

SEQ ID NO: 3402279 - protein, 5 aa, Plasmodium falciparum
SQNKN

SEQ ID NO: 3402280 - protein, 4 aa, Plasmodium falciparum
SQNP

SEQ ID NO: 3402281 - protein, 10 aa, Plasmodium falciparum
SQPNPQEPVE

SEQ ID NO: 3402282 - protein, 6 aa, Plasmodium falciparum
SQRDYS

SEQ ID NO: 3402283 - protein, 9 aa, Plasmodium falciparum
SQSGTAEEF

SEQ ID NO: 3402284 - protein, 7 aa, Plasmodium falciparum
SQSSNGA

SEQ ID NO: 3402285 - protein, 8 aa, Plasmodium falciparum
SQTKEIDE

SEQ ID NO: 3402286 - protein, 5 aa, Plasmodium falciparum
SQTTT

SEQ ID NO: 3402287 - protein, 6 aa, Plasmodium falciparum
SRAITG

SEQ ID NO: 3402288 - protein, 6 aa, Plasmodium falciparum
SRDPTL

SEQ ID NO: 3402289 - protein, 5 aa, Plasmodium falciparum
SREEY

SEQ ID NO: 3402290 - protein, 6 aa, Plasmodium falciparum
SREKPT

SEQ ID NO: 3402291 - protein, 4 aa, Plasmodium falciparum
SRGA

SEQ ID NO: 3402292 - protein, 5 aa, Plasmodium falciparum
SRGRP

SEQ ID NO: 3402293 - protein, 14 aa, Plasmodium falciparum
SRGYPKNILQSDSL

SEQ ID NO: 3402294 - protein, 18 aa, Plasmodium falciparum
SRKDDEKDSSNKNKKKSS

SEQ ID NO: 3402295 - protein, 8 aa, Plasmodium falciparum
SRKEPKKI

SEQ ID NO: 3402296 - protein, 9 aa, Plasmodium falciparum
SRKTNEPLK

SEQ ID NO: 3402297 - protein, 4 aa, Plasmodium falciparum
SRLR

SEQ ID NO: 3402298 - protein, 6 aa, Plasmodium falciparum
SRNIGK

SEQ ID NO: 3402299 - protein, 7 aa, Plasmodium falciparum
SRNMSER

SEQ ID NO: 3402300 - protein, 7 aa, Plasmodium falciparum
SRNPNEF

SEQ ID NO: 3402301 - protein, 8 aa, Plasmodium falciparum
SRNTSNEK

SEQ ID NO: 3402302 - protein, 18 aa, Plasmodium falciparum
SRRNRTKRTKETNGGTQR

SEQ ID NO: 3402303 - protein, 7 aa, Plasmodium falciparum
SRSGGKK

SEQ ID NO: 3402304 - protein, 8 aa, Plasmodium falciparum
SRSGIKNK

SEQ ID NO: 3402305 - protein, 10 aa, Plasmodium falciparum
SRSLSNNSMK

SEQ ID NO: 3402306 - protein, 6 aa, Plasmodium falciparum
SRYPHN

SEQ ID NO: 3402307 - protein, 8 aa, Plasmodium falciparum
SSAAATSL

SEQ ID NO: 3402308 - protein, 18 aa, Plasmodium falciparum
SSDDFEDDEQVNYNENDA

SEQ ID NO: 3402309 - protein, 7 aa, Plasmodium falciparum
SSDGEKY

SEQ ID NO: 3402310 - protein, 6 aa, Plasmodium falciparum
SSDKYS

SEQ ID NO: 3402311 - protein, 12 aa, Plasmodium falciparum
SSEDKTDIKETD

SEQ ID NO: 3402312 - protein, 4 aa, Plasmodium falciparum
SSEE

SEQ ID NO: 3402313 - protein, 7 aa, Plasmodium falciparum
SSEGNSR

SEQ ID NO: 3402314 - protein, 6 aa, Plasmodium falciparum
SSEKEN

SEQ ID NO: 3402315 - protein, 5 aa, Plasmodium falciparum
SSENI

SEQ ID NO: 3402316 - protein, 5 aa, Plasmodium falciparum
SSENP

SEQ ID NO: 3402317 - protein, 5 aa, Plasmodium falciparum
SSEVK

SEQ ID NO: 3402318 - protein, 15 aa, Plasmodium falciparum
SSFSSNMKNEYSDGT

SEQ ID NO: 3402319 - protein, 20 aa, Plasmodium falciparum
SSGHINEDNKTKGAKHNKED

SEQ ID NO: 3402320 - protein, 8 aa, Plasmodium falciparum
SSGKKGYR

SEQ ID NO: 3402321 - protein, 10 aa, Plasmodium falciparum
SSHKNDKEHD

SEQ ID NO: 3402322 - protein, 5 aa, Plasmodium falciparum
SSIEQ

SEQ ID NO: 3402323 - protein, 5 aa, Plasmodium falciparum
SSISN

SEQ ID NO: 3402324 - protein, 8 aa, Plasmodium falciparum
SSKNNQEN

SEQ ID NO: 3402325 - protein, 11 aa, Plasmodium falciparum
SSKPANEYHDG

SEQ ID NO: 3402326 - protein, 9 aa, Plasmodium falciparum
SSKPNEPHW

SEQ ID NO: 3402327 - protein, 6 aa, Plasmodium falciparum
SSKRTK

SEQ ID NO: 3402328 - protein, 14 aa, Plasmodium falciparum
SSLSTNSDKNISED

SEQ ID NO: 3402329 - protein, 6 aa, Plasmodium falciparum
SSNEAS

SEQ ID NO: 3402330 - protein, 7 aa, Plasmodium falciparum
SSNENSY

SEQ ID NO: 3402331 - protein, 21 aa, Plasmodium falciparum
SSNGHNSSSRNSSSSRSRPGK

SEQ ID NO: 3402332 - protein, 10 aa, Plasmodium falciparum
SSNKDGTKGH

SEQ ID NO: 3402333 - protein, 47 aa, Plasmodium falciparum
SSNNITKENNNNNNNNNNNNDKGNFNNLDTNNDSGNLSNNVPKNESH

SEQ ID NO: 3402334 - protein, 6 aa, Plasmodium falciparum
SSNNME

SEQ ID NO: 3402335 - protein, 5 aa, Plasmodium falciparum
SSNTA

SEQ ID NO: 3402336 - protein, 15 aa, Plasmodium falciparum
SSNVNKNNPKSEEEE

SEQ ID NO: 3402337 - protein, 6 aa, Plasmodium falciparum
SSPGAL

SEQ ID NO: 3402338 - protein, 9 aa, Plasmodium falciparum
SSPSKEKMN

SEQ ID NO: 3402339 - protein, 7 aa, Plasmodium falciparum
SSPSTSH

SEQ ID NO: 3402340 - protein, 6 aa, Plasmodium falciparum
SSQLQD

SEQ ID NO: 3402341 - protein, 4 aa, Plasmodium falciparum
SSRG

SEQ ID NO: 3402342 - protein, 9 aa, Plasmodium falciparum
SSRSSSDDL

SEQ ID NO: 3402343 - protein, 5 aa, Plasmodium falciparum
SSSEM

SEQ ID NO: 3402344 - protein, 9 aa, Plasmodium falciparum
SSSLNEYGT

SEQ ID NO: 3402345 - protein, 13 aa, Plasmodium falciparum
SSSNDKNKINKNN

SEQ ID NO: 3402346 - protein, 9 aa, Plasmodium falciparum
SSSSGRINS

SEQ ID NO: 3402347 - protein, 5 aa, Plasmodium falciparum
SSSVP

SEQ ID NO: 3402348 - protein, 11 aa, Plasmodium falciparum
SSSVRSKTDRI

SEQ ID NO: 3402349 - protein, 5 aa, Plasmodium falciparum
SSSWP

SEQ ID NO: 3402350 - protein, 7 aa, Plasmodium falciparum
SSSYINT

SEQ ID NO: 3402351 - protein, 5 aa, Plasmodium falciparum
SSTIE

SEQ ID NO: 3402352 - protein, 9 aa, Plasmodium falciparum
SSTKNIAQQ

SEQ ID NO: 3402353 - protein, 8 aa, Plasmodium falciparum
SSTNIESD

SEQ ID NO: 3402354 - protein, 6 aa, Plasmodium falciparum
SSTNKH

SEQ ID NO: 3402355 - protein, 4 aa, Plasmodium falciparum
SSTY

SEQ ID NO: 3402356 - protein, 6 aa, Plasmodium falciparum
SSVGKS

SEQ ID NO: 3402357 - protein, 5 aa, Plasmodium falciparum
SSVPT

SEQ ID NO: 3402358 - protein, 12 aa, Plasmodium falciparum
STDKNKNKNTEN

SEQ ID NO: 3402359 - protein, 6 aa, Plasmodium falciparum
STDNQN

SEQ ID NO: 3402360 - protein, 36 aa, Plasmodium falciparum
STEEEKDDIKNGKDIKKEIDNDKENIKTNNAKDHST

SEQ ID NO: 3402361 - protein, 6 aa, Plasmodium falciparum
STEKSY

SEQ ID NO: 3402362 - protein, 22 aa, Plasmodium falciparum
STENSKTNTTNSESKTTTTREN

SEQ ID NO: 3402363 - protein, 10 aa, Plasmodium falciparum
STHANQPNNG

SEQ ID NO: 3402364 - protein, 6 aa, Plasmodium falciparum
STHIGK

SEQ ID NO: 3402365 - protein, 12 aa, Plasmodium falciparum
STHTQKENKTTA

SEQ ID NO: 3402366 - protein, 4 aa, Plasmodium falciparum
STIS

SEQ ID NO: 3402367 - protein, 7 aa, Plasmodium falciparum
STKDAQK

SEQ ID NO: 3402368 - protein, 15 aa, Plasmodium falciparum
STKKNTSNNNNNNSN

SEQ ID NO: 3402369 - protein, 12 aa, Plasmodium falciparum
STKNLDKKKNVE

SEQ ID NO: 3402370 - protein, 13 aa, Plasmodium falciparum
STNDITKEDKRNL

SEQ ID NO: 3402371 - protein, 4 aa, Plasmodium falciparum
STNE

SEQ ID NO: 3402372 - protein, 8 aa, Plasmodium falciparum
STNENGNV

SEQ ID NO: 3402373 - protein, 17 aa, Plasmodium falciparum
STNHKNHYEEKKKYESN

SEQ ID NO: 3402374 - protein, 17 aa, Plasmodium falciparum
STNISNDKAGDGTSSTA

SEQ ID NO: 3402375 - protein, 7 aa, Plasmodium falciparum
STNKKPT

SEQ ID NO: 3402376 - protein, 6 aa, Plasmodium falciparum
STNLKK

SEQ ID NO: 3402377 - protein, 8 aa, Plasmodium falciparum
STNNSSIL

SEQ ID NO: 3402378 - protein, 21 aa, Plasmodium falciparum
STNTTVIEDSNGKKNNDEGDY

SEQ ID NO: 3402379 - protein, 5 aa, Plasmodium falciparum
STPGE

SEQ ID NO: 3402380 - protein, 5 aa, Plasmodium falciparum
STPKY

SEQ ID NO: 3402381 - protein, 5 aa, Plasmodium falciparum
STPLY

SEQ ID NO: 3402382 - protein, 5 aa, Plasmodium falciparum
STPVY

SEQ ID NO: 3402383 - protein, 6 aa, Plasmodium falciparum
STQGGS

SEQ ID NO: 3402384 - protein, 4 aa, Plasmodium falciparum
STQS

SEQ ID NO: 3402385 - protein, 4 aa, Plasmodium falciparum
STRI

SEQ ID NO: 3402386 - protein, 5 aa, Plasmodium falciparum
STRTS

SEQ ID NO: 3402387 - protein, 6 aa, Plasmodium falciparum
STSEEC

SEQ ID NO: 3402388 - protein, 12 aa, Plasmodium falciparum
STTKKPNKKNTS

SEQ ID NO: 3402389 - protein, 5 aa, Plasmodium falciparum
STTNY

SEQ ID NO: 3402390 - protein, 5 aa, Plasmodium falciparum
SVATT

SEQ ID NO: 3402391 - protein, 43 aa, Plasmodium falciparum
SVEGDKGPSDDVSDSSGEKKEVKRDRDTLEEIEEGEKPTESME

SEQ ID NO: 3402392 - protein, 6 aa, Plasmodium falciparum
SVLGEE

SEQ ID NO: 3402393 - protein, 5 aa, Plasmodium falciparum
SVPVA

SEQ ID NO: 3402394 - protein, 23 aa, Plasmodium falciparum
SVSEQSNNEPSEKKDGPVPSKPF

SEQ ID NO: 3402395 - protein, 6 aa, Plasmodium falciparum
SVSKTE

SEQ ID NO: 3402396 - protein, 6 aa, Plasmodium falciparum
SVSSNN

SEQ ID NO: 3402397 - protein, 11 aa, Plasmodium falciparum
SVTIEDNGRGI

SEQ ID NO: 3402398 - protein, 6 aa, Plasmodium falciparum
SVTNNQ

SEQ ID NO: 3402399 - protein, 8 aa, Plasmodium falciparum
SVTNPKDL

SEQ ID NO: 3402400 - protein, 14 aa, Plasmodium falciparum
SVTQRGNNNYNNNL

SEQ ID NO: 3402401 - protein, 4 aa, Plasmodium falciparum
SYAN

SEQ ID NO: 3402402 - protein, 15 aa, Plasmodium falciparum
SYDNDNDNDEENEKK

SEQ ID NO: 3402403 - protein, 4 aa, Plasmodium falciparum
SYED

SEQ ID NO: 3402404 - protein, 9 aa, Plasmodium falciparum
SYENNNGSK

SEQ ID NO: 3402405 - protein, 7 aa, Plasmodium falciparum
SYEPNDA

SEQ ID NO: 3402406 - protein, 20 aa, Plasmodium falciparum
SYGKSKLKKGNKKGNKNVSL

SEQ ID NO: 3402407 - protein, 4 aa, Plasmodium falciparum
SYGY

SEQ ID NO: 3402408 - protein, 6 aa, Plasmodium falciparum
SYKGPC

SEQ ID NO: 3402409 - protein, 6 aa, Plasmodium falciparum
SYNSSY

SEQ ID NO: 3402410 - protein, 6 aa, Plasmodium falciparum
SYPGSI

SEQ ID NO: 3402411 - protein, 6 aa, Plasmodium falciparum
SYSGKT

SEQ ID NO: 3402412 - protein, 8 aa, Plasmodium falciparum
SYSKNNKN

SEQ ID NO: 3402413 - protein, 9 aa, Plasmodium falciparum
SYSNKKIDT

SEQ ID NO: 3402414 - protein, 6 aa, Plasmodium falciparum
SYSQQS

SEQ ID NO: 3402415 - protein, 10 aa, Plasmodium falciparum
SYTNKHSSKY

SEQ ID NO: 3402416 - protein, 9 aa, Plasmodium falciparum
SYTTNYNNE

SEQ ID NO: 3402417 - protein, 4 aa, Plasmodium falciparum
SYYE

SEQ ID NO: 3402418 - protein, 5 aa, Plasmodium falciparum
SYYEK

SEQ ID NO: 3402419 - protein, 16 aa, Plasmodium falciparum
TAENSNDSFKPTSGNV

SEQ ID NO: 3402420 - protein, 4 aa, Plasmodium falciparum
TAGN

SEQ ID NO: 3402421 - protein, 15 aa, Plasmodium falciparum
TALNNNSSTISTNKN

SEQ ID NO: 3402422 - protein, 15 aa, Plasmodium falciparum
TANDIDEETKNNKRY

SEQ ID NO: 3402423 - protein, 5 aa, Plasmodium falciparum
TANSI

SEQ ID NO: 3402424 - protein, 7 aa, Plasmodium falciparum
TAPHNSY

SEQ ID NO: 3402425 - protein, 11 aa, Plasmodium falciparum
TAQDDEESSEY

SEQ ID NO: 3402426 - protein, 9 aa, Plasmodium falciparum
TCPSTNSSM

SEQ ID NO: 3402427 - protein, 10 aa, Plasmodium falciparum
TCTFESKNNE

SEQ ID NO: 3402428 - protein, 5 aa, Plasmodium falciparum
TDDNI

SEQ ID NO: 3402429 - protein, 15 aa, Plasmodium falciparum
TDEEDDEGDEVNEEN

SEQ ID NO: 3402430 - protein, 7 aa, Plasmodium falciparum
TDEEERK

SEQ ID NO: 3402431 - protein, 7 aa, Plasmodium falciparum
TDEKEEK

SEQ ID NO: 3402432 - protein, 17 aa, Plasmodium falciparum
TDEQRTRKKMKFINGLL

SEQ ID NO: 3402433 - protein, 17 aa, Plasmodium falciparum
TDESSSSDTKGEHSNLR

SEQ ID NO: 3402434 - protein, 8 aa, Plasmodium falciparum
TDFADETN

SEQ ID NO: 3402435 - protein, 5 aa, Plasmodium falciparum
TDLNK

SEQ ID NO: 3402436 - protein, 5 aa, Plasmodium falciparum
TDLST

SEQ ID NO: 3402437 - protein, 5 aa, Plasmodium falciparum
TDLTG

SEQ ID NO: 3402438 - protein, 6 aa, Plasmodium falciparum
TDQGER

SEQ ID NO: 3402439 - protein, 24 aa, Plasmodium falciparum
TDRLDDNNEENNFQSNSETFDKQE

SEQ ID NO: 3402440 - protein, 9 aa, Plasmodium falciparum
TDSKGNKVS

SEQ ID NO: 3402441 - protein, 13 aa, Plasmodium falciparum
TDTEKQNQQDEKL

SEQ ID NO: 3402442 - protein, 6 aa, Plasmodium falciparum
TDTIPK

SEQ ID NO: 3402443 - protein, 10 aa, Plasmodium falciparum
TDVTNNENNQ

SEQ ID NO: 3402444 - protein, 12 aa, Plasmodium falciparum
TDVTSSESEYEE

SEQ ID NO: 3402445 - protein, 74 aa, Plasmodium falciparum
TDVTTPEEHKEGEHKEEEHKEGEHKEGEHKEEEHKEEEHKKEEHKSKEHKSKGKKDKGKKDKGKHKKAKKEKVK

SEQ ID NO: 3402446 - protein, 5 aa, Plasmodium falciparum
TDYDK

SEQ ID NO: 3402447 - protein, 52 aa, Plasmodium falciparum
TEAQQQAQEQTQEQTEEQEEEQNEKEIESDKQVQKDGEQKENDVQKKQKANA

SEQ ID NO: 3402448 - protein, 6 aa, Plasmodium falciparum
TEDELK

SEQ ID NO: 3402449 - protein, 5 aa, Plasmodium falciparum
TEDTN

SEQ ID NO: 3402450 - protein, 12 aa, Plasmodium falciparum
TEENKELEKSRT

SEQ ID NO: 3402451 - protein, 6 aa, Plasmodium falciparum
TEETCP

SEQ ID NO: 3402452 - protein, 9 aa, Plasmodium falciparum
TEKNNQKKN

SEQ ID NO: 3402453 - protein, 17 aa, Plasmodium falciparum
TEKTNVNNDALKEERNN

SEQ ID NO: 3402454 - protein, 5 aa, Plasmodium falciparum
TEKYL

SEQ ID NO: 3402455 - protein, 16 aa, Plasmodium falciparum
TELEKNKDDNSKSETL

SEQ ID NO: 3402456 - protein, 7 aa, Plasmodium falciparum
TENAAKA

SEQ ID NO: 3402457 - protein, 4 aa, Plasmodium falciparum
TENE

SEQ ID NO: 3402458 - protein, 12 aa, Plasmodium falciparum
TEPLTNQNTNEV

SEQ ID NO: 3402459 - protein, 6 aa, Plasmodium falciparum
TEQGYD

SEQ ID NO: 3402460 - protein, 4 aa, Plasmodium falciparum
TESG

SEQ ID NO: 3402461 - protein, 13 aa, Plasmodium falciparum
TESKNNNNSNNVL

SEQ ID NO: 3402462 - protein, 4 aa, Plasmodium falciparum
TESQ

SEQ ID NO: 3402463 - protein, 16 aa, Plasmodium falciparum
TESRPSMVGVARAKSK

SEQ ID NO: 3402464 - protein, 4 aa, Plasmodium falciparum
TETP

SEQ ID NO: 3402465 - protein, 6 aa, Plasmodium falciparum
TFNENN

SEQ ID NO: 3402466 - protein, 11 aa, Plasmodium falciparum
TFQGNGKASCP

SEQ ID NO: 3402467 - protein, 6 aa, Plasmodium falciparum
TFSSNG

SEQ ID NO: 3402468 - protein, 7 aa, Plasmodium falciparum
TFSTNSN

SEQ ID NO: 3402469 - protein, 12 aa, Plasmodium falciparum
TGAGGQKVNKTN

SEQ ID NO: 3402470 - protein, 10 aa, Plasmodium falciparum
TGDGTVGTES

SEQ ID NO: 3402471 - protein, 6 aa, Plasmodium falciparum
TGDIDN

SEQ ID NO: 3402472 - protein, 5 aa, Plasmodium falciparum
TGDNI

SEQ ID NO: 3402473 - protein, 4 aa, Plasmodium falciparum
TGEQ

SEQ ID NO: 3402474 - protein, 69 aa, Plasmodium falciparum
TGESQTGNTGGGQAGNTGGDQAGSTGGSPQGSTGASPQGSTGASPQGSTGASQPGSSEPSNPVSSGHSV

SEQ ID NO: 3402475 - protein, 27 aa, Plasmodium falciparum
TGESYDGNNVQAQAQAQAQAEAEGSLE

SEQ ID NO: 3402476 - protein, 6 aa, Plasmodium falciparum
TGINEE

SEQ ID NO: 3402477 - protein, 50 aa, Plasmodium falciparum
TGNGKNKSKNKNENKNENKNENKNENKNENKNENKNENKNENKKDIQNNN

SEQ ID NO: 3402478 - protein, 13 aa, Plasmodium falciparum
TGNKDGSGKNPLS

SEQ ID NO: 3402479 - protein, 6 aa, Plasmodium falciparum
TGPCGP

SEQ ID NO: 3402480 - protein, 8 aa, Plasmodium falciparum
TGPPLSGT

SEQ ID NO: 3402481 - protein, 5 aa, Plasmodium falciparum
TGPYG

SEQ ID NO: 3402482 - protein, 16 aa, Plasmodium falciparum
TGQHKPKNATEHGEEN

SEQ ID NO: 3402483 - protein, 5 aa, Plasmodium falciparum
TGQPV

SEQ ID NO: 3402484 - protein, 18 aa, Plasmodium falciparum
TGRKREEQKKKDSGIKQK

SEQ ID NO: 3402485 - protein, 4 aa, Plasmodium falciparum
TGSC

SEQ ID NO: 3402486 - protein, 4 aa, Plasmodium falciparum
TGST

SEQ ID NO: 3402487 - protein, 4 aa, Plasmodium falciparum
TGTC

SEQ ID NO: 3402488 - protein, 6 aa, Plasmodium falciparum
TGTDQN

SEQ ID NO: 3402489 - protein, 5 aa, Plasmodium falciparum
TGTKE

SEQ ID NO: 3402490 - protein, 6 aa, Plasmodium falciparum
TGTQNI

SEQ ID NO: 3402491 - protein, 11 aa, Plasmodium falciparum
TGTSSIAGPKE

SEQ ID NO: 3402492 - protein, 8 aa, Plasmodium falciparum
TGVGKTEL

SEQ ID NO: 3402493 - protein, 132 aa, Plasmodium falciparum
TGYKKDSDHNNENINKKDSNHNNENINKKDSDHNNENINKKDSDHNNENINKKDSDHNNENINKKDSDHNNDTINKKYSDHNNDSINKKYSDHNNDSINKKDSDNNNDTINKKDSDHNNDNINKKDNDHNNN

SEQ ID NO: 3402494 - protein, 5 aa, Plasmodium falciparum
TGYSS

SEQ ID NO: 3402495 - protein, 4 aa, Plasmodium falciparum
TGYY

SEQ ID NO: 3402496 - protein, 5 aa, Plasmodium falciparum
THDKE

SEQ ID NO: 3402497 - protein, 18 aa, Plasmodium falciparum
THEPTHNEHTTTPTNEPI

SEQ ID NO: 3402498 - protein, 6 aa, Plasmodium falciparum
THKGKN

SEQ ID NO: 3402499 - protein, 12 aa, Plasmodium falciparum
THLKNENNNCAQ

SEQ ID NO: 3402500 - protein, 11 aa, Plasmodium falciparum
THNRNNSYYPN

SEQ ID NO: 3402501 - protein, 5 aa, Plasmodium falciparum
THPNE

SEQ ID NO: 3402502 - protein, 28 aa, Plasmodium falciparum
THTADTKYNNITTDNNNNNNNNNNNNND

SEQ ID NO: 3402503 - protein, 10 aa, Plasmodium falciparum
TIDSSNKNRI

SEQ ID NO: 3402504 - protein, 9 aa, Plasmodium falciparum
TIGPASENF

SEQ ID NO: 3402505 - protein, 14 aa, Plasmodium falciparum
TIHDNNNNNNNNNN

SEQ ID NO: 3402506 - protein, 14 aa, Plasmodium falciparum
TIKDKEYQKNIQSY

SEQ ID NO: 3402507 - protein, 20 aa, Plasmodium falciparum
TIKDSNNNNDDDDDDDENYN

SEQ ID NO: 3402508 - protein, 12 aa, Plasmodium falciparum
TIKEEDQSQDMG

SEQ ID NO: 3402509 - protein, 10 aa, Plasmodium falciparum
TIKPEEKKNE

SEQ ID NO: 3402510 - protein, 7 aa, Plasmodium falciparum
TIQKKGS

SEQ ID NO: 3402511 - protein, 17 aa, Plasmodium falciparum
TISTDDKTNDDKRDVNE

SEQ ID NO: 3402512 - protein, 6 aa, Plasmodium falciparum
TKADSD

SEQ ID NO: 3402513 - protein, 13 aa, Plasmodium falciparum
TKAPGKSDKEWNR

SEQ ID NO: 3402514 - protein, 6 aa, Plasmodium falciparum
TKCAYG

SEQ ID NO: 3402515 - protein, 42 aa, Plasmodium falciparum
TKDEKKNKLNEKEGNHMKNNRNNDNNDNNDNNDNNDNNDNEE

SEQ ID NO: 3402516 - protein, 4 aa, Plasmodium falciparum
TKDI

SEQ ID NO: 3402517 - protein, 15 aa, Plasmodium falciparum
TKDNGIHKKTSSNDT

SEQ ID NO: 3402518 - protein, 17 aa, Plasmodium falciparum
TKDNHNNLRGTSQNDSD

SEQ ID NO: 3402519 - protein, 6 aa, Plasmodium falciparum
TKDQKK

SEQ ID NO: 3402520 - protein, 6 aa, Plasmodium falciparum
TKEEFD

SEQ ID NO: 3402521 - protein, 8 aa, Plasmodium falciparum
TKEETRNE

SEQ ID NO: 3402522 - protein, 18 aa, Plasmodium falciparum
TKEKSDNESIDKDSDESI

SEQ ID NO: 3402523 - protein, 6 aa, Plasmodium falciparum
TKENGL

SEQ ID NO: 3402524 - protein, 20 aa, Plasmodium falciparum
TKEPQANLENNKENADDNIT

SEQ ID NO: 3402525 - protein, 6 aa, Plasmodium falciparum
TKEQQF

SEQ ID NO: 3402526 - protein, 14 aa, Plasmodium falciparum
TKGKKNDNDKKYEQ

SEQ ID NO: 3402527 - protein, 4 aa, Plasmodium falciparum
TKHF

SEQ ID NO: 3402528 - protein, 8 aa, Plasmodium falciparum
TKKDAEKY

SEQ ID NO: 3402529 - protein, 19 aa, Plasmodium falciparum
TKKDIQSNNKKKRKTDNFP

SEQ ID NO: 3402530 - protein, 5 aa, Plasmodium falciparum
TKKGC

SEQ ID NO: 3402531 - protein, 19 aa, Plasmodium falciparum
TKKMSQKPEHCGGGIPNRN

SEQ ID NO: 3402532 - protein, 10 aa, Plasmodium falciparum
TKMGDNQNQV

SEQ ID NO: 3402533 - protein, 4 aa, Plasmodium falciparum
TKMY

SEQ ID NO: 3402534 - protein, 18 aa, Plasmodium falciparum
TKNENNNSTMNKDENNIN

SEQ ID NO: 3402535 - protein, 10 aa, Plasmodium falciparum
TKNNLKEKKN

SEQ ID NO: 3402536 - protein, 10 aa, Plasmodium falciparum
TKNVSSISDN

SEQ ID NO: 3402537 - protein, 11 aa, Plasmodium falciparum
TKNYSERSGRV

SEQ ID NO: 3402538 - protein, 16 aa, Plasmodium falciparum
TKPSNSRSKGLQLSPS

SEQ ID NO: 3402539 - protein, 6 aa, Plasmodium falciparum
TKQKDY

SEQ ID NO: 3402540 - protein, 6 aa, Plasmodium falciparum
TKQTNN

SEQ ID NO: 3402541 - protein, 6 aa, Plasmodium falciparum
TKRKEL

SEQ ID NO: 3402542 - protein, 4 aa, Plasmodium falciparum
TKSM

SEQ ID NO: 3402543 - protein, 14 aa, Plasmodium falciparum
TKSQEDDKTKSKKK

SEQ ID NO: 3402544 - protein, 5 aa, Plasmodium falciparum
TKTNR

SEQ ID NO: 3402545 - protein, 20 aa, Plasmodium falciparum
TKTSPNLTTCGSSQPNKNTY

SEQ ID NO: 3402546 - protein, 16 aa, Plasmodium falciparum
TKVKRKKKKKKSAEGM

SEQ ID NO: 3402547 - protein, 13 aa, Plasmodium falciparum
TKYYSDKMGKKNN

SEQ ID NO: 3402548 - protein, 4 aa, Plasmodium falciparum
TLGG

SEQ ID NO: 3402549 - protein, 5 aa, Plasmodium falciparum
TLPRD

SEQ ID NO: 3402550 - protein, 8 aa, Plasmodium falciparum
TLSDPEKR

SEQ ID NO: 3402551 - protein, 9 aa, Plasmodium falciparum
TNDDDHYNI

SEQ ID NO: 3402552 - protein, 9 aa, Plasmodium falciparum
TNDEEKKKE

SEQ ID NO: 3402553 - protein, 11 aa, Plasmodium falciparum
TNDGEKKIECN

SEQ ID NO: 3402554 - protein, 10 aa, Plasmodium falciparum
TNDKEKDEKY

SEQ ID NO: 3402555 - protein, 9 aa, Plasmodium falciparum
TNDKEVKEN

SEQ ID NO: 3402556 - protein, 10 aa, Plasmodium falciparum
TNDNEGEEST

SEQ ID NO: 3402557 - protein, 17 aa, Plasmodium falciparum
TNDNNGASNIRRKAPSN

SEQ ID NO: 3402558 - protein, 6 aa, Plasmodium falciparum
TNDTTL

SEQ ID NO: 3402559 - protein, 4 aa, Plasmodium falciparum
TNEF

SEQ ID NO: 3402560 - protein, 6 aa, Plasmodium falciparum
TNEKED

SEQ ID NO: 3402561 - protein, 17 aa, Plasmodium falciparum
TNEKTQGKNSYHDDENT

SEQ ID NO: 3402562 - protein, 9 aa, Plasmodium falciparum
TNENNDKSE

SEQ ID NO: 3402563 - protein, 6 aa, Plasmodium falciparum
TNENVN

SEQ ID NO: 3402564 - protein, 8 aa, Plasmodium falciparum
TNEQKKEY

SEQ ID NO: 3402565 - protein, 20 aa, Plasmodium falciparum
TNEREDEDDDEDDQDELQNT

SEQ ID NO: 3402566 - protein, 18 aa, Plasmodium falciparum
TNESITNESITNESITNE

SEQ ID NO: 3402567 - protein, 7 aa, Plasmodium falciparum
TNETTSI

SEQ ID NO: 3402568 - protein, 6 aa, Plasmodium falciparum
TNGNKN

SEQ ID NO: 3402569 - protein, 6 aa, Plasmodium falciparum
TNHTNH

SEQ ID NO: 3402570 - protein, 6 aa, Plasmodium falciparum
TNIGKD

SEQ ID NO: 3402571 - protein, 8 aa, Plasmodium falciparum
TNINTETN

SEQ ID NO: 3402572 - protein, 23 aa, Plasmodium falciparum
TNIQNGEGDHINNNNNNNNVRNN

SEQ ID NO: 3402573 - protein, 23 aa, Plasmodium falciparum
TNKEKFEKSEGTFNNISGGEDTF

SEQ ID NO: 3402574 - protein, 10 aa, Plasmodium falciparum
TNKGDTKNDS

SEQ ID NO: 3402575 - protein, 4 aa, Plasmodium falciparum
TNKN

SEQ ID NO: 3402576 - protein, 5 aa, Plasmodium falciparum
TNNDY

SEQ ID NO: 3402577 - protein, 7 aa, Plasmodium falciparum
TNNIDKK

SEQ ID NO: 3402578 - protein, 5 aa, Plasmodium falciparum
TNNND

SEQ ID NO: 3402579 - protein, 46 aa, Plasmodium falciparum
TNNNKKSKFSSNKKKNNNNNINSNSSSNSNNFDDEQNNNNNNIGTH

SEQ ID NO: 3402580 - protein, 6 aa, Plasmodium falciparum
TNQDDS

SEQ ID NO: 3402581 - protein, 4 aa, Plasmodium falciparum
TNQH

SEQ ID NO: 3402582 - protein, 6 aa, Plasmodium falciparum
TNSDPI

SEQ ID NO: 3402583 - protein, 7 aa, Plasmodium falciparum
TNSEGKH

SEQ ID NO: 3402584 - protein, 6 aa, Plasmodium falciparum
TNSNNQ

SEQ ID NO: 3402585 - protein, 7 aa, Plasmodium falciparum
TNSTDST

SEQ ID NO: 3402586 - protein, 9 aa, Plasmodium falciparum
TNSTENDSA

SEQ ID NO: 3402587 - protein, 6 aa, Plasmodium falciparum
TNTYQQ

SEQ ID NO: 3402588 - protein, 5 aa, Plasmodium falciparum
TNWGN

SEQ ID NO: 3402589 - protein, 5 aa, Plasmodium falciparum
TNYEK

SEQ ID NO: 3402590 - protein, 6 aa, Plasmodium falciparum
TNYNSS

SEQ ID NO: 3402591 - protein, 46 aa, Plasmodium falciparum
TPANEPTHNEHATTTTNEPTHNEHATTTTNEPTHNEHATTTTNEPI

SEQ ID NO: 3402592 - protein, 33 aa, Plasmodium falciparum
TPANEPTHNEHATTTTNEPTHNEHTTTPTNEPI

SEQ ID NO: 3402593 - protein, 18 aa, Plasmodium falciparum
TPANEPTHSEHATTTTNE

SEQ ID NO: 3402594 - protein, 9 aa, Plasmodium falciparum
TPEEEEQAL

SEQ ID NO: 3402595 - protein, 8 aa, Plasmodium falciparum
TPEEKEKN

SEQ ID NO: 3402596 - protein, 10 aa, Plasmodium falciparum
TPEPWGDSET

SEQ ID NO: 3402597 - protein, 12 aa, Plasmodium falciparum
TPETKEKKNKKE

SEQ ID NO: 3402598 - protein, 6 aa, Plasmodium falciparum
TPFNPN

SEQ ID NO: 3402599 - protein, 5 aa, Plasmodium falciparum
TPIDE

SEQ ID NO: 3402600 - protein, 6 aa, Plasmodium falciparum
TPKNDD

SEQ ID NO: 3402601 - protein, 6 aa, Plasmodium falciparum
TPLSPK

SEQ ID NO: 3402602 - protein, 8 aa, Plasmodium falciparum
TPPGTSDE

SEQ ID NO: 3402603 - protein, 5 aa, Plasmodium falciparum
TPPQT

SEQ ID NO: 3402604 - protein, 7 aa, Plasmodium falciparum
TPQNDYK

SEQ ID NO: 3402605 - protein, 9 aa, Plasmodium falciparum
TPSTNITSN

SEQ ID NO: 3402606 - protein, 12 aa, Plasmodium falciparum
TPTIASTTAPLS

SEQ ID NO: 3402607 - protein, 12 aa, Plasmodium falciparum
TQCSAPKDYSGP

SEQ ID NO: 3402608 - protein, 8 aa, Plasmodium falciparum
TQDNEHRS

SEQ ID NO: 3402609 - protein, 11 aa, Plasmodium falciparum
TQDVNKKHSCT

SEQ ID NO: 3402610 - protein, 20 aa, Plasmodium falciparum
TQENNNNNNNNNNNISNNNN

SEQ ID NO: 3402611 - protein, 5 aa, Plasmodium falciparum
TQIGD

SEQ ID NO: 3402612 - protein, 4 aa, Plasmodium falciparum
TQKT

SEQ ID NO: 3402613 - protein, 5 aa, Plasmodium falciparum
TQMNN

SEQ ID NO: 3402614 - protein, 10 aa, Plasmodium falciparum
TQNDKEQFSS

SEQ ID NO: 3402615 - protein, 11 aa, Plasmodium falciparum
TQNNSKDKEEK

SEQ ID NO: 3402616 - protein, 13 aa, Plasmodium falciparum
TQPISKKTSVEEK

SEQ ID NO: 3402617 - protein, 5 aa, Plasmodium falciparum
TQSNI

SEQ ID NO: 3402618 - protein, 4 aa, Plasmodium falciparum
TQSS

SEQ ID NO: 3402619 - protein, 6 aa, Plasmodium falciparum
TQYNEP

SEQ ID NO: 3402620 - protein, 6 aa, Plasmodium falciparum
TQYTTT

SEQ ID NO: 3402621 - protein, 12 aa, Plasmodium falciparum
TRSDKKNRLTYP

SEQ ID NO: 3402622 - protein, 8 aa, Plasmodium falciparum
TSAQNNIP

SEQ ID NO: 3402623 - protein, 9 aa, Plasmodium falciparum
TSDDQQLKE

SEQ ID NO: 3402624 - protein, 9 aa, Plasmodium falciparum
TSDNNSESM

SEQ ID NO: 3402625 - protein, 15 aa, Plasmodium falciparum
TSEKKKNYKKKNKED

SEQ ID NO: 3402626 - protein, 11 aa, Plasmodium falciparum
TSENNKKKLKE

SEQ ID NO: 3402627 - protein, 7 aa, Plasmodium falciparum
TSFEKDE

SEQ ID NO: 3402628 - protein, 4 aa, Plasmodium falciparum
TSFN

SEQ ID NO: 3402629 - protein, 10 aa, Plasmodium falciparum
TSGTSYRGEF

SEQ ID NO: 3402630 - protein, 7 aa, Plasmodium falciparum
TSHTNTI

SEQ ID NO: 3402631 - protein, 6 aa, Plasmodium falciparum
TSHYTT

SEQ ID NO: 3402632 - protein, 11 aa, Plasmodium falciparum
TSIHTKEEGPI

SEQ ID NO: 3402633 - protein, 8 aa, Plasmodium falciparum
TSKDNYEA

SEQ ID NO: 3402634 - protein, 5 aa, Plasmodium falciparum
TSKET

SEQ ID NO: 3402635 - protein, 5 aa, Plasmodium falciparum
TSKRL

SEQ ID NO: 3402636 - protein, 4 aa, Plasmodium falciparum
TSKS

SEQ ID NO: 3402637 - protein, 7 aa, Plasmodium falciparum
TSNENNK

SEQ ID NO: 3402638 - protein, 8 aa, Plasmodium falciparum
TSNKENRK

SEQ ID NO: 3402639 - protein, 14 aa, Plasmodium falciparum
TSNNNYEVDENNKG

SEQ ID NO: 3402640 - protein, 11 aa, Plasmodium falciparum
TSQKIKQDEHD

SEQ ID NO: 3402641 - protein, 5 aa, Plasmodium falciparum
TSQPR

SEQ ID NO: 3402642 - protein, 31 aa, Plasmodium falciparum
TSRGSHNTKESKEKSSLRDGVSRNNASDVSR

SEQ ID NO: 3402643 - protein, 12 aa, Plasmodium falciparum
TSSFEDEESKKE

SEQ ID NO: 3402644 - protein, 6 aa, Plasmodium falciparum
TSTDDA

SEQ ID NO: 3402645 - protein, 15 aa, Plasmodium falciparum
TSTLSSDNKNHSPDK

SEQ ID NO: 3402646 - protein, 4 aa, Plasmodium falciparum
TSVK

SEQ ID NO: 3402647 - protein, 35 aa, Plasmodium falciparum
TSYNKSKHTQQNNLGDSLKRTKNNITNISSKKNET

SEQ ID NO: 3402648 - protein, 10 aa, Plasmodium falciparum
TSYNTMPSSQ

SEQ ID NO: 3402649 - protein, 4 aa, Plasmodium falciparum
TTAD

SEQ ID NO: 3402650 - protein, 6 aa, Plasmodium falciparum
TTAYKN

SEQ ID NO: 3402651 - protein, 8 aa, Plasmodium falciparum
TTCNASSG

SEQ ID NO: 3402652 - protein, 61 aa, Plasmodium falciparum
TTDPIGEGKLPASEAGHLRGEGKGNSEENQGQRSNANGAISSNQSTGGKITKQGESKDDGV

SEQ ID NO: 3402653 - protein, 12 aa, Plasmodium falciparum
TTEAKAKETRRK

SEQ ID NO: 3402654 - protein, 5 aa, Plasmodium falciparum
TTEEL

SEQ ID NO: 3402655 - protein, 5 aa, Plasmodium falciparum
TTGME

SEQ ID NO: 3402656 - protein, 8 aa, Plasmodium falciparum
TTGTKRRK

SEQ ID NO: 3402657 - protein, 9 aa, Plasmodium falciparum
TTGVDEKNF

SEQ ID NO: 3402658 - protein, 5 aa, Plasmodium falciparum
TTGYE

SEQ ID NO: 3402659 - protein, 8 aa, Plasmodium falciparum
TTHGNYPH

SEQ ID NO: 3402660 - protein, 14 aa, Plasmodium falciparum
TTKNHSYNQKTPCE

SEQ ID NO: 3402661 - protein, 4 aa, Plasmodium falciparum
TTKQ

SEQ ID NO: 3402662 - protein, 6 aa, Plasmodium falciparum
TTNDEY

SEQ ID NO: 3402663 - protein, 7 aa, Plasmodium falciparum
TTNEESH

SEQ ID NO: 3402664 - protein, 4 aa, Plasmodium falciparum
TTNI

SEQ ID NO: 3402665 - protein, 7 aa, Plasmodium falciparum
TTNKNED

SEQ ID NO: 3402666 - protein, 4 aa, Plasmodium falciparum
TTRL

SEQ ID NO: 3402667 - protein, 17 aa, Plasmodium falciparum
TTSQSVNYDNEKKQINN

SEQ ID NO: 3402668 - protein, 4 aa, Plasmodium falciparum
TTYS

SEQ ID NO: 3402669 - protein, 90 aa, Plasmodium falciparum
TVDESTKEGSQNPKNSSSTTPASGSQKGSSSESPGSSVEKQSQESNKESTNGGNVVSQGTPANTFGQNSNNPSDSPQGTSTLPSPPKSID

SEQ ID NO: 3402670 - protein, 7 aa, Plasmodium falciparum
TVDNPKR

SEQ ID NO: 3402671 - protein, 19 aa, Plasmodium falciparum
TVEDKDKLADKIEKEDKNT

SEQ ID NO: 3402672 - protein, 10 aa, Plasmodium falciparum
TVNEKENNFK

SEQ ID NO: 3402673 - protein, 12 aa, Plasmodium falciparum
TVSTNDNNINHS

SEQ ID NO: 3402674 - protein, 9 aa, Plasmodium falciparum
TYDEESKIY

SEQ ID NO: 3402675 - protein, 8 aa, Plasmodium falciparum
TYDNKENT

SEQ ID NO: 3402676 - protein, 5 aa, Plasmodium falciparum
TYEEK

SEQ ID NO: 3402677 - protein, 9 aa, Plasmodium falciparum
TYEGKGIEE

SEQ ID NO: 3402678 - protein, 8 aa, Plasmodium falciparum
TYEGTGVP

SEQ ID NO: 3402679 - protein, 4 aa, Plasmodium falciparum
TYET

SEQ ID NO: 3402680 - protein, 6 aa, Plasmodium falciparum
TYKNEY

SEQ ID NO: 3402681 - protein, 6 aa, Plasmodium falciparum
TYKSTN

SEQ ID NO: 3402682 - protein, 21 aa, Plasmodium falciparum
TYMSEESGSSAYDAKRAIQNN

SEQ ID NO: 3402683 - protein, 22 aa, Plasmodium falciparum
TYNENNNDNVSDKQEKDKNCPK

SEQ ID NO: 3402684 - protein, 10 aa, Plasmodium falciparum
TYPSSEHNKY

SEQ ID NO: 3402685 - protein, 4 aa, Plasmodium falciparum
TYQQ

SEQ ID NO: 3402686 - protein, 12 aa, Plasmodium falciparum
TYTTKRRNGYGK

SEQ ID NO: 3402687 - protein, 6 aa, Plasmodium falciparum
VAEGAL

SEQ ID NO: 3402688 - protein, 7 aa, Plasmodium falciparum
VAPKKQK

SEQ ID NO: 3402689 - protein, 8 aa, Plasmodium falciparum
VDEQSEEE

SEQ ID NO: 3402690 - protein, 4 aa, Plasmodium falciparum
VDES

SEQ ID NO: 3402691 - protein, 4 aa, Plasmodium falciparum
VDGE

SEQ ID NO: 3402692 - protein, 41 aa, Plasmodium falciparum
VDKNDNRNNINGNSNNNNNNNNNNNEDEDDALPEKEKEPEI

SEQ ID NO: 3402693 - protein, 8 aa, Plasmodium falciparum
VDKRPTRE

SEQ ID NO: 3402694 - protein, 10 aa, Plasmodium falciparum
VDKVSKKKYN

SEQ ID NO: 3402695 - protein, 20 aa, Plasmodium falciparum
VDQNNNQQHIDNNNNNNNNN

SEQ ID NO: 3402696 - protein, 14 aa, Plasmodium falciparum
VDSNGNLKKGAKTT

SEQ ID NO: 3402697 - protein, 6 aa, Plasmodium falciparum
VDSNNE

SEQ ID NO: 3402698 - protein, 8 aa, Plasmodium falciparum
VDTYKGKQ

SEQ ID NO: 3402699 - protein, 6 aa, Plasmodium falciparum
VEAGIG

SEQ ID NO: 3402700 - protein, 6 aa, Plasmodium falciparum
VEASDE

SEQ ID NO: 3402701 - protein, 7 aa, Plasmodium falciparum
VEDQGNC

SEQ ID NO: 3402702 - protein, 7 aa, Plasmodium falciparum
VEEEGEK

SEQ ID NO: 3402703 - protein, 11 aa, Plasmodium falciparum
VEEEGEKVPEE

SEQ ID NO: 3402704 - protein, 9 aa, Plasmodium falciparum
VEEGVQNEE

SEQ ID NO: 3402705 - protein, 73 aa, Plasmodium falciparum
VEEHEEDEEEDKKEKKSENKNKDENKDENDEDNDEISDEDEVDDDVEEDKNENDDIDDDKKETDKTHLEEEEN

SEQ ID NO: 3402706 - protein, 9 aa, Plasmodium falciparum
VEEKNGKAY

SEQ ID NO: 3402707 - protein, 31 aa, Plasmodium falciparum
VEEQGEKVNKNDLNDASSEEIKDSSDFKESH

SEQ ID NO: 3402708 - protein, 16 aa, Plasmodium falciparum
VEETDDPNKKTRTVEK

SEQ ID NO: 3402709 - protein, 4 aa, Plasmodium falciparum
VEGL

SEQ ID NO: 3402710 - protein, 6 aa, Plasmodium falciparum
VEGSRG

SEQ ID NO: 3402711 - protein, 18 aa, Plasmodium falciparum
VEKIRGKKKVTSKTPEMT

SEQ ID NO: 3402712 - protein, 12 aa, Plasmodium falciparum
VENKINKSNNKA

SEQ ID NO: 3402713 - protein, 16 aa, Plasmodium falciparum
VENNKAQGNENFEHTN

SEQ ID NO: 3402714 - protein, 123 aa, Plasmodium falciparum
VEPKEREDEQEETDDEQKETEDEQKETEDEQKETEDEQKETEDEQKETEDEQKESDDEQKETEDEQKETEDEASEEYSDNEEDDEEDEEDDEEENEENNDNETNEENEDNDENEDNDENEEEI

SEQ ID NO: 3402715 - protein, 4 aa, Plasmodium falciparum
VEQL

SEQ ID NO: 3402716 - protein, 8 aa, Plasmodium falciparum
VEQRTAQT

SEQ ID NO: 3402717 - protein, 4 aa, Plasmodium falciparum
VERT

SEQ ID NO: 3402718 - protein, 11 aa, Plasmodium falciparum
VESEKSVSEPA

SEQ ID NO: 3402719 - protein, 8 aa, Plasmodium falciparum
VESSDSTS

SEQ ID NO: 3402720 - protein, 20 aa, Plasmodium falciparum
VGDTDNYNNAHHNDYNQNNV

SEQ ID NO: 3402721 - protein, 7 aa, Plasmodium falciparum
VGGSERE

SEQ ID NO: 3402722 - protein, 10 aa, Plasmodium falciparum
VGNGSSDMFS

SEQ ID NO: 3402723 - protein, 7 aa, Plasmodium falciparum
VGNSPSI

SEQ ID NO: 3402724 - protein, 9 aa, Plasmodium falciparum
VGRKQENEK

SEQ ID NO: 3402725 - protein, 11 aa, Plasmodium falciparum
VGSKASVTEDF

SEQ ID NO: 3402726 - protein, 6 aa, Plasmodium falciparum
VGSTDT

SEQ ID NO: 3402727 - protein, 9 aa, Plasmodium falciparum
VGTTDEKRI

SEQ ID NO: 3402728 - protein, 11 aa, Plasmodium falciparum
VHEQNTNTNKT

SEQ ID NO: 3402729 - protein, 8 aa, Plasmodium falciparum
VHKTNSEK

SEQ ID NO: 3402730 - protein, 18 aa, Plasmodium falciparum
VIPTKKSQTFSTYQDNQP

SEQ ID NO: 3402731 - protein, 11 aa, Plasmodium falciparum
VKDIGSTENEM

SEQ ID NO: 3402732 - protein, 23 aa, Plasmodium falciparum
VKEDSSKKNTNTHDDMDEEEKNE

SEQ ID NO: 3402733 - protein, 41 aa, Plasmodium falciparum
VKEEKNKNDNHNNNNNNISSSSSSSSNTFGEEKEEVSKKKK

SEQ ID NO: 3402734 - protein, 10 aa, Plasmodium falciparum
VKEEQKDYHK

SEQ ID NO: 3402735 - protein, 12 aa, Plasmodium falciparum
VKEEYEKKNYDD

SEQ ID NO: 3402736 - protein, 5 aa, Plasmodium falciparum
VKEKK

SEQ ID NO: 3402737 - protein, 13 aa, Plasmodium falciparum
VKENKDRNEKQTN

SEQ ID NO: 3402738 - protein, 7 aa, Plasmodium falciparum
VKENTKE

SEQ ID NO: 3402739 - protein, 11 aa, Plasmodium falciparum
VKEPKKVEHNK

SEQ ID NO: 3402740 - protein, 18 aa, Plasmodium falciparum
VKKGKGVSTNDHDLDEDD

SEQ ID NO: 3402741 - protein, 9 aa, Plasmodium falciparum
VKKKENHGT

SEQ ID NO: 3402742 - protein, 10 aa, Plasmodium falciparum
VKNEDDEMKA

SEQ ID NO: 3402743 - protein, 20 aa, Plasmodium falciparum
VKPEDTPNTEHVQTDPENSY

SEQ ID NO: 3402744 - protein, 10 aa, Plasmodium falciparum
VKPPKVDPAT

SEQ ID NO: 3402745 - protein, 7 aa, Plasmodium falciparum
VKQDTNY

SEQ ID NO: 3402746 - protein, 13 aa, Plasmodium falciparum
VKSLGKTKECNVN

SEQ ID NO: 3402747 - protein, 12 aa, Plasmodium falciparum
VKSNKDKDELNN

SEQ ID NO: 3402748 - protein, 7 aa, Plasmodium falciparum
VKTREGM

SEQ ID NO: 3402749 - protein, 6 aa, Plasmodium falciparum
VNGGDY

SEQ ID NO: 3402750 - protein, 9 aa, Plasmodium falciparum
VNGTTKDCQ

SEQ ID NO: 3402751 - protein, 11 aa, Plasmodium falciparum
VNKEDSKKKQN

SEQ ID NO: 3402752 - protein, 9 aa, Plasmodium falciparum
VNKEEDTNN

SEQ ID NO: 3402753 - protein, 8 aa, Plasmodium falciparum
VNKESPNL

SEQ ID NO: 3402754 - protein, 8 aa, Plasmodium falciparum
VNKNDPSN

SEQ ID NO: 3402755 - protein, 9 aa, Plasmodium falciparum
VNKNVKEAK

SEQ ID NO: 3402756 - protein, 4 aa, Plasmodium falciparum
VNKT

SEQ ID NO: 3402757 - protein, 30 aa, Plasmodium falciparum
VNLKESDKSYTKAKEACTAASKAKKAVETA

SEQ ID NO: 3402758 - protein, 4 aa, Plasmodium falciparum
VNNN

SEQ ID NO: 3402759 - protein, 9 aa, Plasmodium falciparum
VNNNEEDSS

SEQ ID NO: 3402760 - protein, 5 aa, Plasmodium falciparum
VNNPR

SEQ ID NO: 3402761 - protein, 7 aa, Plasmodium falciparum
VNNPYNK

SEQ ID NO: 3402762 - protein, 10 aa, Plasmodium falciparum
VNNTTNDIKR

SEQ ID NO: 3402763 - protein, 22 aa, Plasmodium falciparum
VNNYNDSNNNNNNNNNNYNNNN

SEQ ID NO: 3402764 - protein, 7 aa, Plasmodium falciparum
VNPEKQE

SEQ ID NO: 3402765 - protein, 8 aa, Plasmodium falciparum
VNRKENVN

SEQ ID NO: 3402766 - protein, 10 aa, Plasmodium falciparum
VNRRDKNGDY

SEQ ID NO: 3402767 - protein, 6 aa, Plasmodium falciparum
VNSDGS

SEQ ID NO: 3402768 - protein, 8 aa, Plasmodium falciparum
VNSEGEKK

SEQ ID NO: 3402769 - protein, 41 aa, Plasmodium falciparum; identical to SEQ ID NO: 3349922

SEQ ID NO: 3402770 - protein, 4 aa, Plasmodium falciparum
VNSQ

SEQ ID NO: 3402771 - protein, 8 aa, Plasmodium falciparum
VNTKRRKK

SEQ ID NO: 3402772 - protein, 14 aa, Plasmodium falciparum
VNTPRDEGYKHNNN

SEQ ID NO: 3402773 - protein, 12 aa, Plasmodium falciparum
VNVNPQRDAPQD

SEQ ID NO: 3402774 - protein, 11 aa, Plasmodium falciparum
VPANSESNLKK

SEQ ID NO: 3402775 - protein, 4 aa, Plasmodium falciparum
VPDT

SEQ ID NO: 3402776 - protein, 6 aa, Plasmodium falciparum
VPGGKN

SEQ ID NO: 3402777 - protein, 19 aa, Plasmodium falciparum
VPGYGGGMSSAKAALESDT

SEQ ID NO: 3402778 - protein, 6 aa, Plasmodium falciparum
VPKGAY

SEQ ID NO: 3402779 - protein, 4 aa, Plasmodium falciparum
VPNA

SEQ ID NO: 3402780 - protein, 4 aa, Plasmodium falciparum
VPND

SEQ ID NO: 3402781 - protein, 7 aa, Plasmodium falciparum
VPPQKTH

SEQ ID NO: 3402782 - protein, 23 aa, Plasmodium falciparum
VPSEENKHASVDPEVKEKENVSE

SEQ ID NO: 3402783 - protein, 10 aa, Plasmodium falciparum
VPSGDSLKTT

SEQ ID NO: 3402784 - protein, 27 aa, Plasmodium falciparum
VPSNPKGQNNNEEDDEEGGDDDDYDDK

SEQ ID NO: 3402785 - protein, 35 aa, Plasmodium falciparum
VPSPKHSNHETFEEETSESEHEEAVSEKNAHETVE

SEQ ID NO: 3402786 - protein, 11 aa, Plasmodium falciparum
VPSQTNNNENI

SEQ ID NO: 3402787 - protein, 4 aa, Plasmodium falciparum
VPYN

SEQ ID NO: 3402788 - protein, 7 aa, Plasmodium falciparum
VQEAQAS

SEQ ID NO: 3402789 - protein, 6 aa, Plasmodium falciparum
VQNRNN

SEQ ID NO: 3402790 - protein, 124 aa, Plasmodium falciparum
VQPGTQLGESGAKETLESQTSPAPQGTSGLQGEKVPGALSSVSQTSSPDVSSRSEQPQTMPESPRPEGTSTESQPRGSTESDASNKNGSQTNVRTISNSSNSITSPQTTQPSNNQNNTVSTTSE

SEQ ID NO: 3402791 - protein, 8 aa, Plasmodium falciparum
VQSESTLD

SEQ ID NO: 3402792 - protein, 7 aa, Plasmodium falciparum
VQTNNAG

SEQ ID NO: 3402793 - protein, 5 aa, Plasmodium falciparum
VRKDE

SEQ ID NO: 3402794 - protein, 5 aa, Plasmodium falciparum
VRKRN

SEQ ID NO: 3402795 - protein, 15 aa, Plasmodium falciparum
VRSEENGKIQDDAKK

SEQ ID NO: 3402796 - protein, 6 aa, Plasmodium falciparum
VSDDMD

SEQ ID NO: 3402797 - protein, 7 aa, Plasmodium falciparum
VSEDPND

SEQ ID NO: 3402798 - protein, 4 aa, Plasmodium falciparum
VSEE

SEQ ID NO: 3402799 - protein, 5 aa, Plasmodium falciparum
VSEET

SEQ ID NO: 3402800 - protein, 5 aa, Plasmodium falciparum
VSENS

SEQ ID NO: 3402801 - protein, 8 aa, Plasmodium falciparum
VSENVPSG

SEQ ID NO: 3402802 - protein, 6 aa, Plasmodium falciparum
VSETPA

SEQ ID NO: 3402803 - protein, 9 aa, Plasmodium falciparum
VSGSEVKEV

SEQ ID NO: 3402804 - protein, 10 aa, Plasmodium falciparum
VSGSNTYDDL

SEQ ID NO: 3402805 - protein, 6 aa, Plasmodium falciparum
VSKDKA

SEQ ID NO: 3402806 - protein, 11 aa, Plasmodium falciparum
VSKSDKNLKDN

SEQ ID NO: 3402807 - protein, 59 aa, Plasmodium falciparum
VSNDDKSSLQNRGNIKNDQKKNNSDYDNDYDNDDNNDDNDDDDDNNYNNNNDDGYDYHT

SEQ ID NO: 3402808 - protein, 5 aa, Plasmodium falciparum
VSPGG

SEQ ID NO: 3402809 - protein, 12 aa, Plasmodium falciparum
VSPKAKMNQQRK

SEQ ID NO: 3402810 - protein, 4 aa, Plasmodium falciparum
VSPS

SEQ ID NO: 3402811 - protein, 15 aa, Plasmodium falciparum
VSQTSTSSEKQDTIQ

SEQ ID NO: 3402812 - protein, 9 aa, Plasmodium falciparum
VSSQEIGEG

SEQ ID NO: 3402813 - protein, 35 aa, Plasmodium falciparum
VSTDGKPNTSSSVVDTNDQRSLPNPRATSLQPPSV

SEQ ID NO: 3402814 - protein, 18 aa, Plasmodium falciparum
VTGDETATKKNTTLPTDG

SEQ ID NO: 3402815 - protein, 5 aa, Plasmodium falciparum
VTGGN

SEQ ID NO: 3402816 - protein, 14 aa, Plasmodium falciparum
VTGVQTEECSCSCS

SEQ ID NO: 3402817 - protein, 16 aa, Plasmodium falciparum
VTIENSNDDDTNRNNI

SEQ ID NO: 3402818 - protein, 6 aa, Plasmodium falciparum
VTKEDQ

SEQ ID NO: 3402819 - protein, 20 aa, Plasmodium falciparum
VTNANKENYEKINKNSEITI

SEQ ID NO: 3402820 - protein, 4 aa, Plasmodium falciparum
VTQK

SEQ ID NO: 3402821 - protein, 7 aa, Plasmodium falciparum
VTSKEGL

SEQ ID NO: 3402822 - protein, 4 aa, Plasmodium falciparum
VTTK

SEQ ID NO: 3402823 - protein, 5 aa, Plasmodium falciparum
VVTNE

SEQ ID NO: 3402824 - protein, 11 aa, Plasmodium falciparum
VYSSNEESLNI

SEQ ID NO: 3402825 - protein, 4 aa, Plasmodium falciparum
WDTT

SEQ ID NO: 3402826 - protein, 7 aa, Plasmodium falciparum
WGNGWGK

SEQ ID NO: 3402827 - protein, 8 aa, Plasmodium falciparum
WGTGSGNQ

SEQ ID NO: 3402828 - protein, 10 aa, Plasmodium falciparum
WNDPNISSYK

SEQ ID NO: 3402829 - protein, 6 aa, Plasmodium falciparum
WSNEYE

SEQ ID NO: 3402830 - protein, 13 aa, Plasmodium falciparum
YAAPNSKEQNDDL

SEQ ID NO: 3402831 - protein, 7 aa, Plasmodium falciparum
YADNSFE

SEQ ID NO: 3402832 - protein, 4 aa, Plasmodium falciparum
YAGG

SEQ ID NO: 3402833 - protein, 4 aa, Plasmodium falciparum
YAPL

SEQ ID NO: 3402834 - protein, 16 aa, Plasmodium falciparum
YAQGGMGGGSPGRGEH

SEQ ID NO: 3402835 - protein, 19 aa, Plasmodium falciparum
YASDEKDLSLNETSGLTNE

SEQ ID NO: 3402836 - protein, 4 aa, Plasmodium falciparum
YCSR

SEQ ID NO: 3402837 - protein, 9 aa, Plasmodium falciparum
YDDDKEQTY

SEQ ID NO: 3402838 - protein, 9 aa, Plasmodium falciparum
YDDKDEIKE

SEQ ID NO: 3402839 - protein, 10 aa, Plasmodium falciparum
YDDTEEEKDL

SEQ ID NO: 3402840 - protein, 8 aa, Plasmodium falciparum
YDEKTENV

SEQ ID NO: 3402841 - protein, 8 aa, Plasmodium falciparum
YDENNQKV

SEQ ID NO: 3402842 - protein, 6 aa, Plasmodium falciparum
YDEYES

SEQ ID NO: 3402843 - protein, 5 aa, Plasmodium falciparum
YDGER

SEQ ID NO: 3402844 - protein, 4 aa, Plasmodium falciparum
YDGK

SEQ ID NO: 3402845 - protein, 4 aa, Plasmodium falciparum
YDIN

SEQ ID NO: 3402846 - protein, 9 aa, Plasmodium falciparum
YDKENDNCT

SEQ ID NO: 3402847 - protein, 8 aa, Plasmodium falciparum
YDKKESED

SEQ ID NO: 3402848 - protein, 5 aa, Plasmodium falciparum
YDKNN

SEQ ID NO: 3402849 - protein, 9 aa, Plasmodium falciparum
YDNAGSIGT

SEQ ID NO: 3402850 - protein, 19 aa, Plasmodium falciparum
YDNNMTSGINKKRKVKDSS

SEQ ID NO: 3402851 - protein, 7 aa, Plasmodium falciparum
YDPELGA

SEQ ID NO: 3402852 - protein, 7 aa, Plasmodium falciparum
YDPSFGA

SEQ ID NO: 3402853 - protein, 5 aa, Plasmodium falciparum
YDPTN

SEQ ID NO: 3402854 - protein, 8 aa, Plasmodium falciparum
YDSKGTPI

SEQ ID NO: 3402855 - protein, 13 aa, Plasmodium falciparum
YDTNANNTNYNTH

SEQ ID NO: 3402856 - protein, 7 aa, Plasmodium falciparum
YDTSNIQ

SEQ ID NO: 3402857 - protein, 9 aa, Plasmodium falciparum
YEDATNAVK

SEQ ID NO: 3402858 - protein, 94 aa, Plasmodium falciparum
YEDQDGDTYDSTIKNEDVDEEVGEEVGEEVGEEVGEEVGEEVGEEVGEEVGEEVGEEEGEEVGEGVGEEVGEEEGEEVGEEEGEYVDEKERQGE

SEQ ID NO: 3402859 - protein, 8 aa, Plasmodium falciparum
YEENKLSE

SEQ ID NO: 3402860 - protein, 14 aa, Plasmodium falciparum
YEGEENKKNPTTYL

SEQ ID NO: 3402861 - protein, 4 aa, Plasmodium falciparum
YEGK

SEQ ID NO: 3402862 - protein, 37 aa, Plasmodium falciparum
YEGTPSSDNPPQENVDANNNEQEYGPPQEEPVSENNV

SEQ ID NO: 3402863 - protein, 10 aa, Plasmodium falciparum
YEISKEKENL

SEQ ID NO: 3402864 - protein, 4 aa, Plasmodium falciparum
YEKG

SEQ ID NO: 3402865 - protein, 4 aa, Plasmodium falciparum
YEKN

SEQ ID NO: 3402866 - protein, 12 aa, Plasmodium falciparum
YEKNNHDKETCG

SEQ ID NO: 3402867 - protein, 8 aa, Plasmodium falciparum
YEKNRNKN

SEQ ID NO: 3402868 - protein, 8 aa, Plasmodium falciparum
YEKSYGTY

SEQ ID NO: 3402869 - protein, 34 aa, Plasmodium falciparum
YENNNNNNNNNNNNNNNMRRDKTSENVKELQNDD

SEQ ID NO: 3402870 - protein, 12 aa, Plasmodium falciparum
YENNVDNHHNDE

SEQ ID NO: 3402871 - protein, 15 aa, Plasmodium falciparum
YEPNGSFDGLNDKEK

SEQ ID NO: 3402872 - protein, 5 aa, Plasmodium falciparum
YEPTK

SEQ ID NO: 3402873 - protein, 4 aa, Plasmodium falciparum
YEQE

SEQ ID NO: 3402874 - protein, 6 aa, Plasmodium falciparum
YEQGTK

SEQ ID NO: 3402875 - protein, 12 aa, Plasmodium falciparum
YEQMSDDNPSMK

SEQ ID NO: 3402876 - protein, 22 aa, Plasmodium falciparum
YEQSGSAQNNLNEQEKKNISLT

SEQ ID NO: 3402877 - protein, 11 aa, Plasmodium falciparum
YESQDTTSSHD

SEQ ID NO: 3402878 - protein, 27 aa, Plasmodium falciparum
YETTESGDTAVSEDSYDKYASNNTNKE

SEQ ID NO: 3402879 - protein, 7 aa, Plasmodium falciparum
YGDDDDN

SEQ ID NO: 3402880 - protein, 21 aa, Plasmodium falciparum
YGDDNGEHSANNINGKEEEVE

SEQ ID NO: 3402881 - protein, 8 aa, Plasmodium falciparum
YGDNEEKL

SEQ ID NO: 3402882 - protein, 6 aa, Plasmodium falciparum
YGEEFG

SEQ ID NO: 3402883 - protein, 7 aa, Plasmodium falciparum
YGKPSEE

SEQ ID NO: 3402884 - protein, 4 aa, Plasmodium falciparum
YGKS

SEQ ID NO: 3402885 - protein, 4 aa, Plasmodium falciparum
YGNT

SEQ ID NO: 3402886 - protein, 5 aa, Plasmodium falciparum
YGSPN

SEQ ID NO: 3402887 - protein, 11 aa, Plasmodium falciparum
YGSTNKGKGGS

SEQ ID NO: 3402888 - protein, 7 aa, Plasmodium falciparum
YISNNAQ

SEQ ID NO: 3402889 - protein, 9 aa, Plasmodium falciparum
YKDDDKIEN

SEQ ID NO: 3402890 - protein, 11 aa, Plasmodium falciparum
YKESNKPISET

SEQ ID NO: 3402891 - protein, 4 aa, Plasmodium falciparum
YKEV

SEQ ID NO: 3402892 - protein, 5 aa, Plasmodium falciparum
YKGNC

SEQ ID NO: 3402893 - protein, 9 aa, Plasmodium falciparum
YKGPCNQPY

SEQ ID NO: 3402894 - protein, 13 aa, Plasmodium falciparum
YKITYDKENNHKM

SEQ ID NO: 3402895 - protein, 9 aa, Plasmodium falciparum
YKKKNNNDV

SEQ ID NO: 3402896 - protein, 18 aa, Plasmodium falciparum
YKKTQDNTNNSNNNNDHM

SEQ ID NO: 3402897 - protein, 11 aa, Plasmodium falciparum
YKNCDNPSSSY

SEQ ID NO: 3402898 - protein, 22 aa, Plasmodium falciparum
YKNKKKTERQKNIERKKYSTVQ

SEQ ID NO: 3402899 - protein, 13 aa, Plasmodium falciparum
YKPQSDDQEINEK

SEQ ID NO: 3402900 - protein, 25 aa, Plasmodium falciparum
YKQEIDNKIKNDENGNNNIKTDTNG

SEQ ID NO: 3402901 - protein, 5 aa, Plasmodium falciparum
YKQEN

SEQ ID NO: 3402902 - protein, 11 aa, Plasmodium falciparum
YKREENKKDDY

SEQ ID NO: 3402903 - protein, 10 aa, Plasmodium falciparum
YKRPDNADYH

SEQ ID NO: 3402904 - protein, 4 aa, Plasmodium falciparum
YKRT

SEQ ID NO: 3402905 - protein, 5 aa, Plasmodium falciparum
YKRTD

SEQ ID NO: 3402906 - protein, 5 aa, Plasmodium falciparum
YKSFD

SEQ ID NO: 3402907 - protein, 8 aa, Plasmodium falciparum
YKSGTQTK

SEQ ID NO: 3402908 - protein, 6 aa, Plasmodium falciparum
YKSSNT

SEQ ID NO: 3402909 - protein, 7 aa, Plasmodium falciparum
YKSTNIN

SEQ ID NO: 3402910 - protein, 9 aa, Plasmodium falciparum
YKSTYNNNP

SEQ ID NO: 3402911 - protein, 11 aa, Plasmodium falciparum
YKTTSEELEET

SEQ ID NO: 3402912 - protein, 8 aa, Plasmodium falciparum
YNDEEKDR

SEQ ID NO: 3402913 - protein, 9 aa, Plasmodium falciparum
YNDNEKKEF

SEQ ID NO: 3402914 - protein, 4 aa, Plasmodium falciparum
YNDS

SEQ ID NO: 3402915 - protein, 18 aa, Plasmodium falciparum
YNEDDNSPDMDTDDPVES

SEQ ID NO: 3402916 - protein, 11 aa, Plasmodium falciparum
YNEEKSEPIKL

SEQ ID NO: 3402917 - protein, 13 aa, Plasmodium falciparum
YNEKEENQNTTND

SEQ ID NO: 3402918 - protein, 5 aa, Plasmodium falciparum
YNEPY

SEQ ID NO: 3402919 - protein, 10 aa, Plasmodium falciparum
YNGGKTPFAG

SEQ ID NO: 3402920 - protein, 4 aa, Plasmodium falciparum
YNGS

SEQ ID NO: 3402921 - protein, 9 aa, Plasmodium falciparum
YNKINKRKQ

SEQ ID NO: 3402922 - protein, 8 aa, Plasmodium falciparum
YNKSCDNS

SEQ ID NO: 3402923 - protein, 9 aa, Plasmodium falciparum
YNNDDEEIN

SEQ ID NO: 3402924 - protein, 5 aa, Plasmodium falciparum
YNNDN

SEQ ID NO: 3402925 - protein, 10 aa, Plasmodium falciparum
YNNKKGKKPI

SEQ ID NO: 3402926 - protein, 10 aa, Plasmodium falciparum
YNNNNNNDTN

SEQ ID NO: 3402927 - protein, 5 aa, Plasmodium falciparum
YNNQN

SEQ ID NO: 3402928 - protein, 7 aa, Plasmodium falciparum
YNNYNNN

SEQ ID NO: 3402929 - protein, 9 aa, Plasmodium falciparum
YNPDDENLN

SEQ ID NO: 3402930 - protein, 14 aa, Plasmodium falciparum
YNPKSPNDRIDEGS

SEQ ID NO: 3402931 - protein, 9 aa, Plasmodium falciparum
YNRPRGPTQ

SEQ ID NO: 3402932 - protein, 9 aa, Plasmodium falciparum
YNSLNQGKP

SEQ ID NO: 3402933 - protein, 7 aa, Plasmodium falciparum
YNSRNLK

SEQ ID NO: 3402934 - protein, 9 aa, Plasmodium falciparum
YNSSDKTNQ

SEQ ID NO: 3402935 - protein, 24 aa, Plasmodium falciparum
YNTPSNMENNYNSYSSNDQKNYIS

SEQ ID NO: 3402936 - protein, 4 aa, Plasmodium falciparum
YNTT

SEQ ID NO: 3402937 - protein, 15 aa, Plasmodium falciparum
YNTTTDYNNKDTKTS

SEQ ID NO: 3402938 - protein, 4 aa, Plasmodium falciparum
YPAI

SEQ ID NO: 3402939 - protein, 8 aa, Plasmodium falciparum
YPDQSSGD

SEQ ID NO: 3402940 - protein, 4 aa, Plasmodium falciparum
YPDS

SEQ ID NO: 3402941 - protein, 6 aa, Plasmodium falciparum
YPESNS

SEQ ID NO: 3402942 - protein, 9 aa, Plasmodium falciparum
YPKEYSTDY

SEQ ID NO: 3402943 - protein, 4 aa, Plasmodium falciparum
YPLN

SEQ ID NO: 3402944 - protein, 8 aa, Plasmodium falciparum
YPNETKEK

SEQ ID NO: 3402945 - protein, 5 aa, Plasmodium falciparum
YPNKY

SEQ ID NO: 3402946 - protein, 17 aa, Plasmodium falciparum
YPNNNSKYKEENKSKDH

SEQ ID NO: 3402947 - protein, 11 aa, Plasmodium falciparum
YPRDDQKWRAK

SEQ ID NO: 3402948 - protein, 57 aa, Plasmodium falciparum
YQHEKGEQKYDDKTYDDKTYDDKTYDDKTYDDKTYGDSEKYDEGEHFEGDENYKVKE

SEQ ID NO: 3402949 - protein, 22 aa, Plasmodium falciparum
YREQEKKIKTKQKNNNNNDGYG

SEQ ID NO: 3402950 - protein, 4 aa, Plasmodium falciparum
YRKE

SEQ ID NO: 3402951 - protein, 10 aa, Plasmodium falciparum
YRNDQDTSTL

SEQ ID NO: 3402952 - protein, 11 aa, Plasmodium falciparum
YRNIGTKNASN

SEQ ID NO: 3402953 - protein, 8 aa, Plasmodium falciparum
YRNKKSKN

SEQ ID NO: 3402954 - protein, 8 aa, Plasmodium falciparum
YRSTTDEL

SEQ ID NO: 3402955 - protein, 5 aa, Plasmodium falciparum
YRTDE

SEQ ID NO: 3402956 - protein, 17 aa, Plasmodium falciparum
YSDGKSNVLEKSKNNEV

SEQ ID NO: 3402957 - protein, 4 aa, Plasmodium falciparum
YSEN

SEQ ID NO: 3402958 - protein, 10 aa, Plasmodium falciparum
YSKNNYGLND

SEQ ID NO: 3402959 - protein, 10 aa, Plasmodium falciparum
YSLGNNLPEK

SEQ ID NO: 3402960 - protein, 10 aa, Plasmodium falciparum
YSNNDDNNDI

SEQ ID NO: 3402961 - protein, 17 aa, Plasmodium falciparum
YSNRAAENFKAIRELNV

SEQ ID NO: 3402962 - protein, 7 aa, Plasmodium falciparum
YSPKGGF

SEQ ID NO: 3402963 - protein, 6 aa, Plasmodium falciparum
YSQNKD

SEQ ID NO: 3402964 - protein, 5 aa, Plasmodium falciparum
YSQQK

SEQ ID NO: 3402965 - protein, 6 aa, Plasmodium falciparum
YSSDGI

SEQ ID NO: 3402966 - protein, 4 aa, Plasmodium falciparum
YSSN

SEQ ID NO: 3402967 - protein, 9 aa, Plasmodium falciparum
YTDDYENKK

SEQ ID NO: 3402968 - protein, 11 aa, Plasmodium falciparum
YTINSDDYTEK

SEQ ID NO: 3402969 - protein, 5 aa, Plasmodium falciparum
YTNMD

SEQ ID NO: 3402970 - protein, 7 aa, Plasmodium falciparum
YTPTNKE

SEQ ID NO: 3402971 - protein, 9 aa, Plasmodium falciparum
YTPTPTLDT

SEQ ID NO: 3402972 - protein, 16 aa, Plasmodium falciparum
YTQQTSYGGWANPSED

SEQ ID NO: 3402973 - protein, 9 aa, Plasmodium falciparum
YTQTKTPLK

SEQ ID NO: 3402974 - protein, 11 aa, Plasmodium falciparum
YTSTKSVDNQI

SEQ ID NO: 3402975 - protein, 6 aa, Plasmodium falciparum
YTTKGR

SEQ ID NO: 3402976 - protein, 19 aa, Plasmodium falciparum
YTYTTNENADTKFNKNEPM

SEQ ID NO: 3402977 - protein, 6 aa, Plasmodium falciparum
YYKEEY

SEQ ID NO: 3402978 - protein, 12 aa, Plasmodium falciparum
YYKNDKSNYNSF

SEQ ID NO: 3402979 - protein, 4 aa, Plasmodium falciparum
YYKR

SEQ ID NO: 3402980 - protein, 18 aa, Plasmodium falciparum
YYSTSTKELGQTSDNPAD

SEQ ID NO: 3402981 - protein, 15 aa, Plasmodium falciparum
YYYNNSDNNNYNERK

SEQ ID NO: 3402982 - protein, 19 aa, Plasmodium falciparum
NVSLFFLLIFKYSYKNIVK

SEQ ID NO: 3402983 - protein, 17 aa, Plasmodium falciparum
PELVPISVLSTMTLACP

SEQ ID NO: 3402984 - protein, 19 aa, Plasmodium falciparum
CYLLNIKYCQGYGLTETAG

SEQ ID NO: 3402985 - protein, 17 aa, Plasmodium falciparum
DESRWILKPEIGQIAKV

SEQ ID NO: 3402986 - protein, 19 aa, Plasmodium falciparum
DSMFSGYFLEKECTKNAFT

SEQ ID NO: 3402987 - protein, 24 aa, Plasmodium falciparum
EDQKNCALSWAFASKYHLETIKCM

SEQ ID NO: 3402988 - protein, 18 aa, Plasmodium falciparum
FELYKFPLEILKHYYKKT

SEQ ID NO: 3402989 - protein, 20 aa, Plasmodium falciparum
FKLLGIYGSNSINWLASDLS

SEQ ID NO: 3402990 - protein, 18 aa, Plasmodium falciparum
FLEKECTKNAFTDDGYFK

SEQ ID NO: 3402991 - protein, 27 aa, Plasmodium falciparum
KGKGFCGVIKRWGFKRGPMSHGSSHHR

SEQ ID NO: 3402992 - protein, 25 aa, Plasmodium falciparum
KIKYSPSFATFRVWKNNTRRISKLY

SEQ ID NO: 3402993 - protein, 23 aa, Plasmodium falciparum
KKCEKCGKKLMLFDDMTKTQTKK

SEQ ID NO: 3402994 - protein, 18 aa, Plasmodium falciparum
KLPRNFFELYKFPLEILK

SEQ ID NO: 3402995 - protein, 17 aa, Plasmodium falciparum
SRWILKPEIGQIAKVGC

SEQ ID NO: 3402996 - protein, 24 aa, Plasmodium falciparum
AAKRACKDLGFPNGIHIKENCANL

SEQ ID NO: 3402997 - protein, 19 aa, Plasmodium falciparum
ADANHGFHFNLHDNNSHTL

SEQ ID NO: 3402998 - protein, 18 aa, Plasmodium falciparum
ADFGLFLVPHIYVHVKSE

SEQ ID NO: 3402999 - protein, 22 aa, Plasmodium falciparum
AELLESIILKKKFVRFRVTDAI

SEQ ID NO: 3403000 - protein, 21 aa, Plasmodium falciparum
AFEPRFAIGTGQPVSYDILNK

SEQ ID NO: 3403001 - protein, 18 aa, Plasmodium falciparum
AFWDAFMCGYKVHIGNKP

SEQ ID NO: 3403002 - protein, 18 aa, Plasmodium falciparum
AFYTYALASYEGYEIAQN

SEQ ID NO: 3403003 - protein, 24 aa, Plasmodium falciparum
AGLIKKKVECIELSASEISPHENK

SEQ ID NO: 3403004 - protein, 17 aa, Plasmodium falciparum
AHLEKLSLIKSINKKES

SEQ ID NO: 3403005 - protein, 32 aa, Plasmodium falciparum
AIKKKLFVFPLCFIKVYPFIFKNKVAFQNVED

SEQ ID NO: 3403006 - protein, 26 aa, Plasmodium falciparum
AKEASSYDYILGWEFGGGVPEHKKEE

SEQ ID NO: 3403007 - protein, 17 aa, Plasmodium falciparum
AKKIIQWRKENGMILTT

SEQ ID NO: 3403008 - protein, 22 aa, Plasmodium falciparum
AKLCAEERCEICCNLKKNEYQK

SEQ ID NO: 3403009 - protein, 22 aa, Plasmodium falciparum
AKLRYPSKVIAFFNNFVILSTK

SEQ ID NO: 3403010 - protein, 19 aa, Plasmodium falciparum
AKNDLFFIKPSVKLNLCSS

SEQ ID NO: 3403011 - protein, 22 aa, Plasmodium falciparum
AKNNIKKCYFIKREGYRNIGTK

SEQ ID NO: 3403012 - protein, 27 aa, Plasmodium falciparum
AKTKKHYWIHLPFKYNIIKISDDNTTS

SEQ ID NO: 3403013 - protein, 19 aa, Plasmodium falciparum
AKTLSCFNFNTELQQTKYL

SEQ ID NO: 3403014 - protein, 17 aa, Plasmodium falciparum
AKYRGDFEERLKSILKE

SEQ ID NO: 3403015 - protein, 26 aa, Plasmodium falciparum
ALCTLTLHLFCIFLCLGKEVRSEENG

SEQ ID NO: 3403016 - protein, 25 aa, Plasmodium falciparum
ALHLCKPLKVKLCAPSQGLCLNKIL

SEQ ID NO: 3403017 - protein, 23 aa, Plasmodium falciparum
ALLNCKSYGKSKLKKGNKKGNKN

SEQ ID NO: 3403018 - protein, 17 aa, Plasmodium falciparum
ALLSLDFSLFITYFQQK

SEQ ID NO: 3403019 - protein, 26 aa, Plasmodium falciparum
ALSLEFKKRINIGIIYNTNYSVMKLF

SEQ ID NO: 3403020 - protein, 22 aa, Plasmodium falciparum
ANCIFFKIFTIVIFCILQCASH

SEQ ID NO: 3403021 - protein, 24 aa, Plasmodium falciparum
ANDWMKNKTGLVLPQLKYSLNKFN

SEQ ID NO: 3403022 - protein, 24 aa, Plasmodium falciparum
ANGKKLFICRKHLKEFDTFTLKCN

SEQ ID NO: 3403023 - protein, 18 aa, Plasmodium falciparum
ANISTYYKATAQRINSYF

SEQ ID NO: 3403024 - protein, 18 aa, Plasmodium falciparum
ANMISYITYFYKNKKSLC

SEQ ID NO: 3403025 - protein, 23 aa, Plasmodium falciparum
ANRHKFVIATKICGRTDKLPWMK

SEQ ID NO: 3403026 - protein, 19 aa, Plasmodium falciparum
APYQLPYLVGHYDSRSGIK

SEQ ID NO: 3403027 - protein, 24 aa, Plasmodium falciparum
AREIIKLGGKCLLLKKNTQDIVYQ

SEQ ID NO: 3403028 - protein, 24 aa, Plasmodium falciparum
ARNREIQAILPLKGKILNVEKIKN

SEQ ID NO: 3403029 - protein, 21 aa, Plasmodium falciparum
ARTYVSFDIIRRILVNYFKYD

SEQ ID NO: 3403030 - protein, 26 aa, Plasmodium falciparum
ASCPYNMKIGFGFSLTFQKSINTNIK

SEQ ID NO: 3403031 - protein, 21 aa, Plasmodium falciparum
ASFDYQKRIILDGDIFCKSSF

SEQ ID NO: 3403032 - protein, 24 aa, Plasmodium falciparum
ASFREFYRKYGLNADMSDDGGNND

SEQ ID NO: 3403033 - protein, 17 aa, Plasmodium falciparum
ASYEVSQIFSYYKRKRK

SEQ ID NO: 3403034 - protein, 20 aa, Plasmodium falciparum
ATACCKTKGILICKYDNNTN

SEQ ID NO: 3403035 - protein, 19 aa, Plasmodium falciparum
ATCKYGFNKIELLKNVCEE

SEQ ID NO: 3403036 - protein, 20 aa, Plasmodium falciparum
ATIHSCSRYLLNSKPFRIWI

SEQ ID NO: 3403037 - protein, 20 aa, Plasmodium falciparum
AVLAKGFLRNKEHANLINSY

SEQ ID NO: 3403038 - protein, 18 aa, Plasmodium falciparum
AVTLYLFYYYLKDIKSML

SEQ ID NO: 3403039 - protein, 17 aa, Plasmodium falciparum
AVTTCYWNGSEKNLEDY

SEQ ID NO: 3403040 - protein, 26 aa, Plasmodium falciparum
AVYENIKITFLMKENINNFLFTQYSY

SEQ ID NO: 3403041 - protein, 25 aa, Plasmodium falciparum
AYECTMAGISVCKDGTPFNKIAEAM

SEQ ID NO: 3403042 - protein, 24 aa, Plasmodium falciparum
AYGKEKYPLVLLGSSYNSLNQGKP

SEQ ID NO: 3403043 - protein, 18 aa, Plasmodium falciparum
AYGLKNVCKLNFLNFNGF

SEQ ID NO: 3403044 - protein, 19 aa, Plasmodium falciparum
AYICFIYMRAKCEALKINN

SEQ ID NO: 3403045 - protein, 18 aa, Plasmodium falciparum
AYKVFMIKYNEMILENYV

SEQ ID NO: 3403046 - protein, 17 aa, Plasmodium falciparum
AYQILSYKIRKEIYDNE

SEQ ID NO: 3403047 - protein, 18 aa, Plasmodium falciparum
CADILKLALVDLYDNLKD

SEQ ID NO: 3403048 - protein, 17 aa, Plasmodium falciparum
CCKTCIKIIQLLYQIIK

SEQ ID NO: 3403049 - protein, 17 aa, Plasmodium falciparum
CDFTGKYSHLFTYSKKP

SEQ ID NO: 3403050 - protein, 21 aa, Plasmodium falciparum
CENKKLLKYVFTKYTKENGLQ

SEQ ID NO: 3403051 - protein, 17 aa, Plasmodium falciparum
CEQNSVLCSYWLLYHKI

SEQ ID NO: 3403052 - protein, 24 aa, Plasmodium falciparum
CERDYSITCPKGWSYSVKDDMCMG

SEQ ID NO: 3403053 - protein, 17 aa, Plasmodium falciparum
CFAPWPCKDNCQPDWTK

SEQ ID NO: 3403054 - protein, 19 aa, Plasmodium falciparum
CFDVIRLRFVKLETASSVV

SEQ ID NO: 3403055 - protein, 22 aa, Plasmodium falciparum
CFICLFFLCILKGVYNVKTQKN

SEQ ID NO: 3403056 - protein, 20 aa, Plasmodium falciparum
CFNDKEVLGSYIYMSKSPIC

SEQ ID NO: 3403057 - protein, 19 aa, Plasmodium falciparum
CGFIFRIVGERNYWSLMID

SEQ ID NO: 3403058 - protein, 19 aa, Plasmodium falciparum
CGHCKRLIPEYNEAANMLN

SEQ ID NO: 3403059 - protein, 17 aa, Plasmodium falciparum
CGSCYANSASFIINSRV

SEQ ID NO: 3403060 - protein, 17 aa, Plasmodium falciparum
CHFNFIHSVVIFNVDLP

SEQ ID NO: 3403061 - protein, 23 aa, Plasmodium falciparum
CIDLDLVEGLLCHIKELPHLKKL

SEQ ID NO: 3403062 - protein, 25 aa, Plasmodium falciparum
CIEGECILEESFLKRMIEDSTHLIN

SEQ ID NO: 3403063 - protein, 29 aa, Plasmodium falciparum
CIFLVLFTFIDIVKPFKGNYGEANFSFFQ

SEQ ID NO: 3403064 - protein, 19 aa, Plasmodium falciparum
CIILVLCSVQRCLSDEQNI

SEQ ID NO: 3403065 - protein, 18 aa, Plasmodium falciparum
CIYKEKKTIFNIYNIYDD

SEQ ID NO: 3403066 - protein, 19 aa, Plasmodium falciparum
CKDYRYHTFEESIKNVNNR

SEQ ID NO: 3403067 - protein, 17 aa, Plasmodium falciparum
CKKGHINHECSNNKEEN

SEQ ID NO: 3403068 - protein, 24 aa, Plasmodium falciparum
CKKRLKSLNNEGGFSNTYHNDVKK

SEQ ID NO: 3403069 - protein, 19 aa, Plasmodium falciparum
CKKVFKPEFVNRIDKIGVF

SEQ ID NO: 3403070 - protein, 21 aa, Plasmodium falciparum
CKLNFLNFNGFLPLYKTNKYF

SEQ ID NO: 3403071 - protein, 18 aa, Plasmodium falciparum
CKNIFIKNLDEIEDVDEE

SEQ ID NO: 3403072 - protein, 21 aa, Plasmodium falciparum
CKNKPSPGYCLAKLKNTNECF

SEQ ID NO: 3403073 - protein, 20 aa, Plasmodium falciparum
CKNKYSNKVHLFGFSSKEEI

SEQ ID NO: 3403074 - protein, 32 aa, Plasmodium falciparum
CKRNYSYSCPIGWKETLSFCLAPNSYKFNCNK

SEQ ID NO: 3403075 - protein, 20 aa, Plasmodium falciparum
CKTNEQKKEYGLITQNIRAF

SEQ ID NO: 3403076 - protein, 30 aa, Plasmodium falciparum
CLASVGFYKKFACKNLFFENSFIRKDLHTY

SEQ ID NO: 3403077 - protein, 18 aa, Plasmodium falciparum
CLDLDLVDGLLLHRHELP

SEQ ID NO: 3403078 - protein, 18 aa, Plasmodium falciparum
CLFFFVVLGACNNVKERI

SEQ ID NO: 3403079 - protein, 26 aa, Plasmodium falciparum
CLFVLCCLKLKHVNFLKWEQENDFYY

SEQ ID NO: 3403080 - protein, 21 aa, Plasmodium falciparum
CLGMISACMLVGTYGRMNVVS

SEQ ID NO: 3403081 - protein, 25 aa, Plasmodium falciparum
CLILFLVCFCQGHKNYLKRDNYLQY

SEQ ID NO: 3403082 - protein, 17 aa, Plasmodium falciparum
CLLKLYKKLKEEIKKEN

SEQ ID NO: 3403083 - protein, 18 aa, Plasmodium falciparum
CLYFYNSFFEHYKGIYKW

SEQ ID NO: 3403084 - protein, 25 aa, Plasmodium falciparum
CNEIDENKCASGFVNYILQNIQKRD

SEQ ID NO: 3403085 - protein, 20 aa, Plasmodium falciparum
CNHYKFMYLNSIKRKDIFIK

SEQ ID NO: 3403086 - protein, 19 aa, Plasmodium falciparum
CNIPKNYTVGDVLRYVKNK

SEQ ID NO: 3403087 - protein, 20 aa, Plasmodium falciparum
CPHGKVVMFGFSLKQNFWDN

SEQ ID NO: 3403088 - protein, 19 aa, Plasmodium falciparum
CPIMYHLEACILKYSYPRD

SEQ ID NO: 3403089 - protein, 19 aa, Plasmodium falciparum
CPLNWKVEKGYCLAPDTFD

SEQ ID NO: 3403090 - protein, 18 aa, Plasmodium falciparum
CPNAFIIVVTNPVDVMVQ

SEQ ID NO: 3403091 - protein, 18 aa, Plasmodium falciparum
CPPLYKITYNKFFDNSIK

SEQ ID NO: 3403092 - protein, 19 aa, Plasmodium falciparum
CPSGTLKLTNCFKDAIVHT

SEQ ID NO: 3403093 - protein, 24 aa, Plasmodium falciparum
CQINWLADCPFGWDRKKEDKRDQK

SEQ ID NO: 3403094 - protein, 18 aa, Plasmodium falciparum
CQSIKKFIKELLSAATND

SEQ ID NO: 3403095 - protein, 20 aa, Plasmodium falciparum
CRDKVCGKGKCIVDPANSLT

SEQ ID NO: 3403096 - protein, 24 aa, Plasmodium falciparum
CRKREVDFLYEMEIMDALDKKHID

SEQ ID NO: 3403097 - protein, 20 aa, Plasmodium falciparum
CRPFDLKRSGFVMGEGSGIL

SEQ ID NO: 3403098 - protein, 25 aa, Plasmodium falciparum
CRRDYTNICPLDWNVSAYDKNLCIP

SEQ ID NO: 3403099 - protein, 18 aa, Plasmodium falciparum
CRRTFRISNFQTVTRLSN

SEQ ID NO: 3403100 - protein, 23 aa, Plasmodium falciparum
CSAPKDYSGPCAHIMILEPMNAK

SEQ ID NO: 3403101 - protein, 30 aa, Plasmodium falciparum
CSCKMRTIFPLPRLTIQSVFHELKSIPNLI

SEQ ID NO: 3403102 - protein, 19 aa, Plasmodium falciparum
CSCYLLVPYCRYFDVLYFP

SEQ ID NO: 3403103 - protein, 17 aa, Plasmodium falciparum
CSDHSFIFEKRLNEELL

SEQ ID NO: 3403104 - protein, 17 aa, Plasmodium falciparum
CSNGIVGTMFKFLDSKN

SEQ ID NO: 3403105 - protein, 19 aa, Plasmodium falciparum
CSRRWFKGSSSYYLTEELN

SEQ ID NO: 3403106 - protein, 18 aa, Plasmodium falciparum
CSSQDFLNNFLIYIDTFK

SEQ ID NO: 3403107 - protein, 20 aa, Plasmodium falciparum
CSSSSEFSGTSFLDDKELEH

SEQ ID NO: 3403108 - protein, 17 aa, Plasmodium falciparum
CTIGQCFRYEQTSRLRK

SEQ ID NO: 3403109 - protein, 19 aa, Plasmodium falciparum
CVFLLVCIFYPTAYHKSSS

SEQ ID NO: 3403110 - protein, 24 aa, Plasmodium falciparum
CVIKKVEKAYDCFVVHKKKKEANE

SEQ ID NO: 3403111 - protein, 21 aa, Plasmodium falciparum
CVKYFSELRRKFFQIYRDPNN

SEQ ID NO: 3403112 - protein, 19 aa, Plasmodium falciparum
CYDIEAWLPSQQRYVEVSS

SEQ ID NO: 3403113 - protein, 20 aa, Plasmodium falciparum
CYFIKREGYRNIGTKNASNA

SEQ ID NO: 3403114 - protein, 23 aa, Plasmodium falciparum
CYHKNIYIDLRMKWLSNQYNENI

SEQ ID NO: 3403115 - protein, 17 aa, Plasmodium falciparum
DAASPGFCLSELEKTND

SEQ ID NO: 3403116 - protein, 25 aa, Plasmodium falciparum
DANDCLKHNIDIRFFIETSEKVKHS

SEQ ID NO: 3403117 - protein, 20 aa, Plasmodium falciparum
DAYMKLNLCMGYSLGEYAAL

SEQ ID NO: 3403118 - protein, 25 aa, Plasmodium falciparum
DCIKECKRIGFPVMIKASQGGGGKG

SEQ ID NO: 3403119 - protein, 27 aa, Plasmodium falciparum
DCKRNYSFACPLGWIPSKKINYCKAPL

SEQ ID NO: 3403120 - protein, 17 aa, Plasmodium falciparum
DCNMTLYYQEFHLSDDI

SEQ ID NO: 3403121 - protein, 18 aa, Plasmodium falciparum
DDIIKFGLLLSLDNKNKN

SEQ ID NO: 3403122 - protein, 24 aa, Plasmodium falciparum
DDKKERWNPFLFIIECADPSKENA

SEQ ID NO: 3403123 - protein, 23 aa, Plasmodium falciparum
DDLLKCRREIFFKDRHLLENNNI

SEQ ID NO: 3403124 - protein, 21 aa, Plasmodium falciparum
DDNLLRIFGYDTLYPSHTNYS

SEQ ID NO: 3403125 - protein, 24 aa, Plasmodium falciparum
DDTMFEICLPYSVIQYKKNAYGKE

SEQ ID NO: 3403126 - protein, 18 aa, Plasmodium falciparum
DDVHLFYPPHNVLHNVVL

SEQ ID NO: 3403127 - protein, 17 aa, Plasmodium falciparum
DDVMGIFDKIFKNNVDD

SEQ ID NO: 3403128 - protein, 18 aa, Plasmodium falciparum
DDYFVIKEIVCIYIESKN

SEQ ID NO: 3403129 - protein, 23 aa, Plasmodium falciparum
DDYLMKITHVIRGVEHISNTFKQ

SEQ ID NO: 3403130 - protein, 34 aa, Plasmodium falciparum
DDYYPYKNCYDLYPLVRKNIKNICNFETNSIYKE

SEQ ID NO: 3403131 - protein, 19 aa, Plasmodium falciparum
DEDNCKVLNPYEKIDKHFD

SEQ ID NO: 3403132 - protein, 23 aa, Plasmodium falciparum
DEINFSLIIPLSFQLNYSTCFIW

SEQ ID NO: 3403133 - protein, 22 aa, Plasmodium falciparum
DEINLFPPYIKKLYYEKYEKYR

SEQ ID NO: 3403134 - protein, 18 aa, Plasmodium falciparum
DEKIRITVFNNYMEESVM

SEQ ID NO: 3403135 - protein, 22 aa, Plasmodium falciparum
DEKLKLSSFFDRSTNINLDVGE

SEQ ID NO: 3403136 - protein, 23 aa, Plasmodium falciparum
DELTKCKSFLSLITPNELFLNDD

SEQ ID NO: 3403137 - protein, 22 aa, Plasmodium falciparum
DEMPDFLKKGTFHDDYINKLNE

SEQ ID NO: 3403138 - protein, 26 aa, Plasmodium falciparum
DEVNKYKGFFIGYGFNDDIPSVIHHY

SEQ ID NO: 3403139 - protein, 22 aa, Plasmodium falciparum
DFEYKKLVGIYEKYKEVCGNAS

SEQ ID NO: 3403140 - protein, 22 aa, Plasmodium falciparum
DFFKKVLCFSNTLNTYEGKGIE

SEQ ID NO: 3403141 - protein, 19 aa, Plasmodium falciparum
DFREIPGISNLLRHAIFYK

SEQ ID NO: 3403142 - protein, 28 aa, Plasmodium falciparum
DGESIIGAPYDWRYPLSQQNYKILKEHI

SEQ ID NO: 3403143 - protein, 19 aa, Plasmodium falciparum
DGLKTVQRRIIWSMYEINK

SEQ ID NO: 3403144 - protein, 31 aa, Plasmodium falciparum
DGRKIKIKNFERIKENVLERAIIVKELDKLK

SEQ ID NO: 3403145 - protein, 19 aa, Plasmodium falciparum
DGSFKIGRANTMFKELKEE

SEQ ID NO: 3403146 - protein, 18 aa, Plasmodium falciparum
DGSSVFGSIFGSLLTPID

SEQ ID NO: 3403147 - protein, 23 aa, Plasmodium falciparum
DHGVPIYCLYSTINKKETEYLLY

SEQ ID NO: 3403148 - protein, 18 aa, Plasmodium falciparum
DIDICGPSIPVLTKTIDH

SEQ ID NO: 3403149 - protein, 23 aa, Plasmodium falciparum
DIKLNSEDKIECHNFSDNEDKCN

SEQ ID NO: 3403150 - protein, 27 aa, Plasmodium falciparum
DIKNMFLKILKCRDLSNTEPREYHLPL

SEQ ID NO: 3403151 - protein, 23 aa, Plasmodium falciparum
DIKVYTFYFYKYILIYKNFKKST

SEQ ID NO: 3403152 - protein, 26 aa, Plasmodium falciparum
DILLKSSFKPGASFNIPDFNKKNFEF

SEQ ID NO: 3403153 - protein, 25 aa, Plasmodium falciparum
DINKFFKKEIEGHPYFQKIKKKNEK

SEQ ID NO: 3403154 - protein, 27 aa, Plasmodium falciparum
DINKIKECAKLFIGHHNFECFRGTLKG

SEQ ID NO: 3403155 - protein, 19 aa, Plasmodium falciparum
DIPYSYILLTFEYFCDHTI

SEQ ID NO: 3403156 - protein, 24 aa, Plasmodium falciparum
DISCFKCIRLNNRSIYKNKYKNNV

SEQ ID NO: 3403157 - protein, 19 aa, Plasmodium falciparum
DIVFLSFLVGNDFLPHIPN

SEQ ID NO: 3403158 - protein, 24 aa, Plasmodium falciparum
DIVQKLNLTFGFPTVIALSLSKNV

SEQ ID NO: 3403159 - protein, 25 aa, Plasmodium falciparum
DIYACPRGWLNLMNSGACKAPDDYI

SEQ ID NO: 3403160 - protein, 20 aa, Plasmodium falciparum
DIYDCFKIKNFEYPNTHPVY

SEQ ID NO: 3403161 - protein, 20 aa, Plasmodium falciparum
DIYVLKSWFKSMDIKKIKYI

SEQ ID NO: 3403162 - protein, 20 aa, Plasmodium falciparum
DKCFRFLKNRTRRLYKGREK

SEQ ID NO: 3403163 - protein, 24 aa, Plasmodium falciparum
DKCNSFKKCTYVNIDNKDTCFLDY

SEQ ID NO: 3403164 - protein, 26 aa, Plasmodium falciparum
DKDNLLYKKVYAMRDYFYKIFYDHYN

SEQ ID NO: 3403165 - protein, 27 aa, Plasmodium falciparum
DKFELLPLKFLKFHGSTNIDQVIDAMD

SEQ ID NO: 3403166 - protein, 17 aa, Plasmodium falciparum
DKFHCVKNYLSNLNFSS

SEQ ID NO: 3403167 - protein, 20 aa, Plasmodium falciparum
DKFIFNKDIHNILLELKESL

SEQ ID NO: 3403168 - protein, 24 aa, Plasmodium falciparum
DKGIGLRFPRFLRLREDKNAEQAT

SEQ ID NO: 3403169 - protein, 17 aa, Plasmodium falciparum
DKILFVYIGTFKEEIFK

SEQ ID NO: 3403170 - protein, 18 aa, Plasmodium falciparum
DKKGYKKCARIVGEVIGK

SEQ ID NO: 3403171 - protein, 21 aa, Plasmodium falciparum
DKKKKFRVIVVSSDKDLLQLL

SEQ ID NO: 3403172 - protein, 19 aa, Plasmodium falciparum
DKNLLEFGDEGVKDIGSTE

SEQ ID NO: 3403173 - protein, 22 aa, Plasmodium falciparum
DKSHRAICGGGRYNFFLNNNKI

SEQ ID NO: 3403174 - protein, 28 aa, Plasmodium falciparum
DKVIENFKEDIELLKKKVDDLEKRKSDN

SEQ ID NO: 3403175 - protein, 18 aa, Plasmodium falciparum
DKYFFEFVSEVNLQEGKE

SEQ ID NO: 3403176 - protein, 26 aa, Plasmodium falciparum
DKYLRKGRRVYVQGSLHTRKWHTNDM

SEQ ID NO: 3403177 - protein, 22 aa, Plasmodium falciparum
DKYMLGILFIWIWNDHHLWECS

SEQ ID NO: 3403178 - protein, 17 aa, Plasmodium falciparum
DLFRSFRKNLNYLISDY

SEQ ID NO: 3403179 - protein, 23 aa, Plasmodium falciparum
DLFSELNNFFGFGNLADGMFGRK

SEQ ID NO: 3403180 - protein, 18 aa, Plasmodium falciparum
DLIGFVCPSGTLKLTNCF

SEQ ID NO: 3403181 - protein, 20 aa, Plasmodium falciparum
DLKYSKFFFHGNYITLCNNV

SEQ ID NO: 3403182 - protein, 20 aa, Plasmodium falciparum
DLNVPLLGNCRVEFINIQSE

SEQ ID NO: 3403183 - protein, 17 aa, Plasmodium falciparum
DMFIFNFDGVINLNKQE

SEQ ID NO: 3403184 - protein, 24 aa, Plasmodium falciparum
DMIFYDKMVFHFSKDGMMIKTDKK

SEQ ID NO: 3403185 - protein, 20 aa, Plasmodium falciparum
DMQGEACLRILNQQETLREQ

SEQ ID NO: 3403186 - protein, 18 aa, Plasmodium falciparum
DMSIICFEYNAGLYERNL

SEQ ID NO: 3403187 - protein, 19 aa, Plasmodium falciparum
DNCLKRLKTSYIDLLQLHW

SEQ ID NO: 3403188 - protein, 20 aa, Plasmodium falciparum
DNDISFKCICVDLKKKKYNV

SEQ ID NO: 3403189 - protein, 22 aa, Plasmodium falciparum
DNEIRRAIQILSRRTKNNPILL

SEQ ID NO: 3403190 - protein, 17 aa, Plasmodium falciparum
DNGKLHFPYGFPRNIDF

SEQ ID NO: 3403191 - protein, 18 aa, Plasmodium falciparum
DNLDLGLFSKFSYQSDIQ

SEQ ID NO: 3403192 - protein, 17 aa, Plasmodium falciparum
DNNLLSISSVFGSVKST

SEQ ID NO: 3403193 - protein, 21 aa, Plasmodium falciparum
DNVPYHLKNCRIFQLNLGNIV

SEQ ID NO: 3403194 - protein, 20 aa, Plasmodium falciparum
DNYKLGVQYFFLRPYISKND

SEQ ID NO: 3403195 - protein, 25 aa, Plasmodium falciparum
DPKKNYFTFCMKKIFQKINYDLFRS

SEQ ID NO: 3403196 - protein, 19 aa, Plasmodium falciparum
DPYIPYIYKDIAPVLKEYA

SEQ ID NO: 3403197 - protein, 22 aa, Plasmodium falciparum
DQGNCASSWAFASKLHFETLRC

SEQ ID NO: 3403198 - protein, 24 aa, Plasmodium falciparum
DQKGKKGFVSSFFDDLMSLIYFPK

SEQ ID NO: 3403199 - protein, 22 aa, Plasmodium falciparum
DQRKMCSNMVFTIEPIISESST

SEQ ID NO: 3403200 - protein, 18 aa, Plasmodium falciparum
DRFCYDYSNPSPIKKTTK

SEQ ID NO: 3403201 - protein, 31 aa, Plasmodium falciparum
DSENGSTTYCYMRYTFNFNLEKLNENSRSQL

SEQ ID NO: 3403202 - protein, 22 aa, Plasmodium falciparum
DSICKIKNKIIYADIGNVTSSD

SEQ ID NO: 3403203 - protein, 17 aa, Plasmodium falciparum
DSIFKGYFLERELTENS

SEQ ID NO: 3403204 - protein, 17 aa, Plasmodium falciparum
DSLLFTFLTNAFNQIEE

SEQ ID NO: 3403205 - protein, 26 aa, Plasmodium falciparum
DSPWGKGRPGWHIECSTMASNILGDV

SEQ ID NO: 3403206 - protein, 17 aa, Plasmodium falciparum
DSSICLSAIHAGIYDKH

SEQ ID NO: 3403207 - protein, 29 aa, Plasmodium falciparum
DSVSCGKSNCWLPCLFGSPCSDRCYNCGV

SEQ ID NO: 3403208 - protein, 23 aa, Plasmodium falciparum
DTIQMKILLNWNEDGINTEDPNY

SEQ ID NO: 3403209 - protein, 19 aa, Plasmodium falciparum
DTLNLFCSIILKEEESNLI

SEQ ID NO: 3403210 - protein, 21 aa, Plasmodium falciparum
DTLSNVFLRAELKRIKDIPPI

SEQ ID NO: 3403211 - protein, 19 aa, Plasmodium falciparum
DTNFMIYIIRLTKYKDMNF

SEQ ID NO: 3403212 - protein, 23 aa, Plasmodium falciparum
DTRLLPLFFKELKNIYCEENNDI

SEQ ID NO: 3403213 - protein, 17 aa, Plasmodium falciparum
DTSRLKYYISQKLNVCP

SEQ ID NO: 3403214 - protein, 17 aa, Plasmodium falciparum
DTVTYSFLTNVVDNTNY

SEQ ID NO: 3403215 - protein, 23 aa, Plasmodium falciparum
DVENCYHCTLLAKKVDSNNECFN

SEQ ID NO: 3403216 - protein, 24 aa, Plasmodium falciparum
DVHLGKGIIIGSVFLTKDFIIPNG

SEQ ID NO: 3403217 - protein, 28 aa, Plasmodium falciparum
DVIRYPEDFKLDIGKNVILPTARSRAFE

SEQ ID NO: 3403218 - protein, 22 aa, Plasmodium falciparum
DVKNPTTCLSFYVNYKNENKMT

SEQ ID NO: 3403219 - protein, 17 aa, Plasmodium falciparum
DVMYIIWETISKHIFND

SEQ ID NO: 3403220 - protein, 24 aa, Plasmodium falciparum
DVNKKQSFKFILYLQHDLITIKWK

SEQ ID NO: 3403221 - protein, 22 aa, Plasmodium falciparum
DWTKPCPQNWILKKGNHKLSSL

SEQ ID NO: 3403222 - protein, 26 aa, Plasmodium falciparum
DYDIGKGCHCRSCTDFTREISLNNME

SEQ ID NO: 3403223 - protein, 20 aa, Plasmodium falciparum
DYIKEWFNKINWDFANYNLS

SEQ ID NO: 3403224 - protein, 24 aa, Plasmodium falciparum
DYILSKLILIYSFDEKIRITVFNN

SEQ ID NO: 3403225 - protein, 24 aa, Plasmodium falciparum
DYIRTDGKVSFDMATLQKTIKNFG

SEQ ID NO: 3403226 - protein, 21 aa, Plasmodium falciparum
DYKYWVFDCIGSLNDKKPEST

SEQ ID NO: 3403227 - protein, 17 aa, Plasmodium falciparum
DYLILKLYVENGGCKGL

SEQ ID NO: 3403228 - protein, 29 aa, Plasmodium falciparum
DYPNNMYVCQSFYDFIYSYFLSYNHHFFD

SEQ ID NO: 3403229 - protein, 22 aa, Plasmodium falciparum
DYSFCIRISRLLSQNNKEGEKP

SEQ ID NO: 3403230 - protein, 22 aa, Plasmodium falciparum
EAGDVESKCYLGYIYYFIDGYK

SEQ ID NO: 3403231 - protein, 20 aa, Plasmodium falciparum
EAISKLTLDPSMMNMLNNKD

SEQ ID NO: 3403232 - protein, 19 aa, Plasmodium falciparum
EAKVSGSYWGIASFSASTG

SEQ ID NO: 3403233 - protein, 20 aa, Plasmodium falciparum
ECDLIKKLIITFSQENVEMK

SEQ ID NO: 3403234 - protein, 24 aa, Plasmodium falciparum
EDAIAELLLSYFNVFYPISTCMCY

SEQ ID NO: 3403235 - protein, 26 aa, Plasmodium falciparum
EDAKLSSSPRPEGPRANNRNENNQNT

SEQ ID NO: 3403236 - protein, 19 aa, Plasmodium falciparum
EDFRLIPLNDFFNKILLEL

SEQ ID NO: 3403237 - protein, 18 aa, Plasmodium falciparum
EDIPHVLENDIIIVPPYL

SEQ ID NO: 3403238 - protein, 25 aa, Plasmodium falciparum
EDIPKEHYNLFLKYKNLLFEQIAEN

SEQ ID NO: 3403239 - protein, 21 aa, Plasmodium falciparum
EDKQRIVLTDGNNVYILEEVT

SEQ ID NO: 3403240 - protein, 25 aa, Plasmodium falciparum
EDQKNCALSWAFASIYHLETIKCMK

SEQ ID NO: 3403241 - protein, 21 aa, Plasmodium falciparum
EDRILPFGLKENFWEMAETGP

SEQ ID NO: 3403242 - protein, 23 aa, Plasmodium falciparum
EECFYKRLIKTYVDILFNSYKYP

SEQ ID NO: 3403243 - protein, 23 aa, Plasmodium falciparum
EEDSEPFPRQKHKKVDNHNEEKN

SEQ ID NO: 3403244 - protein, 22 aa, Plasmodium falciparum
EEILNFLKNLKIMQNIKNYNIN

SEQ ID NO: 3403245 - protein, 24 aa, Plasmodium falciparum
EEKDLKNAALILRKYTNLIDTVEV

SEQ ID NO: 3403246 - protein, 18 aa, Plasmodium falciparum
EEKMKFSLHLNKKEITNI

SEQ ID NO: 3403247 - protein, 22 aa, Plasmodium falciparum
EEKRWAYLRLQKNEYIMKKVIG

SEQ ID NO: 3403248 - protein, 24 aa, Plasmodium falciparum
EELLYKIFGCITNKIYKWGELFRN

SEQ ID NO: 3403249 - protein, 21 aa, Plasmodium falciparum
EEMIKILGLLTVTLWAKEGKK

SEQ ID NO: 3403250 - protein, 22 aa, Plasmodium falciparum
EESISFAWDLLTNVYKINPDRL

SEQ ID NO: 3403251 - protein, 25 aa, Plasmodium falciparum
EEYNLRYQGNFVFDGYRIYLGFDYK

SEQ ID NO: 3403252 - protein, 19 aa, Plasmodium falciparum
EFCAYDMNYFIESIKKGYV

SEQ ID NO: 3403253 - protein, 21 aa, Plasmodium falciparum
EFFSGFNPFGTMKIRKEQNPD

SEQ ID NO: 3403254 - protein, 19 aa, Plasmodium falciparum
EFLQYLKCELPDISNSFAQ

SEQ ID NO: 3403255 - protein, 18 aa, Plasmodium falciparum
EFNEIKKKFYLYIHPSKM

SEQ ID NO: 3403256 - protein, 25 aa, Plasmodium falciparum
EFNSIDILKRISFFQFFDNFYLNAH

SEQ ID NO: 3403257 - protein, 20 aa, Plasmodium falciparum
EFNTLMLKADYFIRDINTRG

SEQ ID NO: 3403258 - protein, 21 aa, Plasmodium falciparum
EGELDWKIIAINKEDKHYEDI

SEQ ID NO: 3403259 - protein, 25 aa, Plasmodium falciparum
EGKLFIKEKFVPLIEKCKRLNRAIR

SEQ ID NO: 3403260 - protein, 23 aa, Plasmodium falciparum
EGLCEKLKHMIYYYYEEYVMKNS

SEQ ID NO: 3403261 - protein, 32 aa, Plasmodium falciparum
EGLSNIYGAKYYLRSGLFNEKNGKGQKYEDLE

SEQ ID NO: 3403262 - protein, 19 aa, Plasmodium falciparum
EGNEFLMSILHMKSLYGNN

SEQ ID NO: 3403263 - protein, 23 aa, Plasmodium falciparum
EGRTVKNIITWICKETQSNIDIS

SEQ ID NO: 3403264 - protein, 24 aa, Plasmodium falciparum
EGTWRTILSHSLCEGISISINEDN

SEQ ID NO: 3403265 - protein, 23 aa, Plasmodium falciparum
EHAFKLAAGLAIKEAAKKTSIRL

SEQ ID NO: 3403266 - protein, 30 aa, Plasmodium falciparum
EHIRILLLTFLYRFQKEIIENGNVYVACPP

SEQ ID NO: 3403267 - protein, 24 aa, Plasmodium falciparum
EHMCKMKSAYIFDMIFQNIKYPFK

SEQ ID NO: 3403268 - protein, 21 aa, Plasmodium falciparum
EHQNHGWFRLLGIYGSNSINW

SEQ ID NO: 3403269 - protein, 25 aa, Plasmodium falciparum
EHTAGKLPFWLSPRQAIVLPIGDKY

SEQ ID NO: 3403270 - protein, 21 aa, Plasmodium falciparum
EHYNDGGICLGEEDELSDAEH

SEQ ID NO: 3403271 - protein, 20 aa, Plasmodium falciparum
EIENTLELRKICTNLSEQDN

SEQ ID NO: 3403272 - protein, 20 aa, Plasmodium falciparum
EIFAYSVYVHAHLDKKNVDT

SEQ ID NO: 3403273 - protein, 19 aa, Plasmodium falciparum
EIIFGKKYYFGLGNYVRKR

SEQ ID NO: 3403274 - protein, 24 aa, Plasmodium falciparum
EIIHKFEIIGHIAHLNFCDKLESC

SEQ ID NO: 3403275 - protein, 20 aa, Plasmodium falciparum
EIKIRKSLYLSDKLDIGQNK

SEQ ID NO: 3403276 - protein, 31 aa, Plasmodium falciparum
EIKSKIFYINSYRVGDQFFPTYSNLGKDDHD

SEQ ID NO: 3403277 - protein, 24 aa, Plasmodium falciparum
EILSKSFLSYANFLILNRCLCDYR

SEQ ID NO: 3403278 - protein, 21 aa, Plasmodium falciparum
EILTLRLTKINDELKKLKDIS

SEQ ID NO: 3403279 - protein, 21 aa, Plasmodium falciparum
EINQFPSFQIDTLYMKRKRAR

SEQ ID NO: 3403280 - protein, 17 aa, Plasmodium falciparum
EIQNKGSVIAYIKTENV

SEQ ID NO: 3403281 - protein, 30 aa, Plasmodium falciparum
EIRDFSSAYPMEWLPVIYRDVFEQIEKEKE

SEQ ID NO: 3403282 - protein, 18 aa, Plasmodium falciparum
EIRLCYDKKITLKHPKYD

SEQ ID NO: 3403283 - protein, 22 aa, Plasmodium falciparum
EISPRNGLLRVREFQMAEIEYF

SEQ ID NO: 3403284 - protein, 22 aa, Plasmodium falciparum
EIYDPTNSVAIFFFDLKTAEAY

SEQ ID NO: 3403285 - protein, 24 aa, Plasmodium falciparum
EIYKMYPGKILLTLKNIQKINDLN

SEQ ID NO: 3403286 - protein, 22 aa, Plasmodium falciparum
EKCNYSYRKNMKMSNIQFSDNS

SEQ ID NO: 3403287 - protein, 25 aa, Plasmodium falciparum
EKDSQICFFILKLLKKNYKSFDEDI

SEQ ID NO: 3403288 - protein, 22 aa, Plasmodium falciparum
EKFGNLKGIEYLDYFNNTGIGI

SEQ ID NO: 3403289 - protein, 21 aa, Plasmodium falciparum
EKFLNSFKWALEYRLKNTNCN

SEQ ID NO: 3403290 - protein, 17 aa, Plasmodium falciparum
EKFMKQKLRAERLRKIR

SEQ ID NO: 3403291 - protein, 17 aa, Plasmodium falciparum
EKFSKICNVKWLCVENS

SEQ ID NO: 3403292 - protein, 26 aa, Plasmodium falciparum
EKIEISKKCHIFWPCENYEILLKKLI

SEQ ID NO: 3403293 - protein, 19 aa, Plasmodium falciparum
EKIMKRSKITWNEKKSHHL

SEQ ID NO: 3403294 - protein, 21 aa, Plasmodium falciparum
EKKKEYSFLMLGKENEEENKE

SEQ ID NO: 3403295 - protein, 24 aa, Plasmodium falciparum
EKKKLDEEFFLHGYSKYEDEEQIK

SEQ ID NO: 3403296 - protein, 22 aa, Plasmodium falciparum
EKKLKSPYFRRNKYCNNEYCDR

SEQ ID NO: 3403297 - protein, 21 aa, Plasmodium falciparum
EKKPWAAETIKMVKDSLDKEV

SEQ ID NO: 3403298 - protein, 21 aa, Plasmodium falciparum
EKKQLPVVHFAKKDVELAKIR

SEQ ID NO: 3403299 - protein, 21 aa, Plasmodium falciparum
EKLKNSALCLKNIDDWLKNKN

SEQ ID NO: 3403300 - protein, 27 aa, Plasmodium falciparum
EKLKYGGSFDTIFSGFVNLLTPSSPTQ

SEQ ID NO: 3403301 - protein, 17 aa, Plasmodium falciparum
EKLTFYFYDERSENKNS

SEQ ID NO: 3403302 - protein, 19 aa, Plasmodium falciparum
EKRNSLFYKYIDKNIDLKN

SEQ ID NO: 3403303 - protein, 31 aa, Plasmodium falciparum
EKSSIRLTKMIKYRGAGTIEYLYDQINKKYF

SEQ ID NO: 3403304 - protein, 25 aa, Plasmodium falciparum
EKYNYEWICIIPTNIYGKYDNFNLE

SEQ ID NO: 3403305 - protein, 24 aa, Plasmodium falciparum
EKYWPECRGTAVPGYCLSTHDDKN

SEQ ID NO: 3403306 - protein, 22 aa, Plasmodium falciparum
ELDDYFKFCMKFKKSNQNYDLY

SEQ ID NO: 3403307 - protein, 23 aa, Plasmodium falciparum
ELFLKMREGYLFVFFFYTKYHHE

SEQ ID NO: 3403308 - protein, 17 aa, Plasmodium falciparum
ELFSWKCEVEWPCISAP

SEQ ID NO: 3403309 - protein, 20 aa, Plasmodium falciparum
ELIGSGWRVPKILNEVTEFF

SEQ ID NO: 3403310 - protein, 20 aa, Plasmodium falciparum
ELIVLLYVIQIFVIKSKKIF

SEQ ID NO: 3403311 - protein, 29 aa, Plasmodium falciparum
ELKKKYEIGKYIDVVICYIHKKNNIIQVT

SEQ ID NO: 3403312 - protein, 26 aa, Plasmodium falciparum
ELKRIKDIPPIISYYIYNKNKNEYEK

SEQ ID NO: 3403313 - protein, 27 aa, Plasmodium falciparum
ELNEAGICPWGNYFSCMEKYVKEHIKN

SEQ ID NO: 3403314 - protein, 20 aa, Plasmodium falciparum
ELPHLKNLIILDTLSKNKEI

SEQ ID NO: 3403315 - protein, 23 aa, Plasmodium falciparum
ELRQEIRRQMGILEDELEEKERM

SEQ ID NO: 3403316 - protein, 22 aa, Plasmodium falciparum
ELRSFLRRVYIVPIIYISESGI

SEQ ID NO: 3403317 - protein, 19 aa, Plasmodium falciparum
ELSEAYQILSYKIRKEIYD

SEQ ID NO: 3403318 - protein, 19 aa, Plasmodium falciparum
ELWETCVFGVGKIQVRASG

SEQ ID NO: 3403319 - protein, 18 aa, Plasmodium falciparum
ELYDGFVMYNGTYVSLYD

SEQ ID NO: 3403320 - protein, 31 aa, Plasmodium falciparum
EMFIRFNKFLKLKVSFYSLLLLLLFIIYIFF

SEQ ID NO: 3403321 - protein, 19 aa, Plasmodium falciparum
ENCKFARELMDDVSYIICE

SEQ ID NO: 3403322 - protein, 20 aa, Plasmodium falciparum
ENCSPFYCEKIMKAKEIERL

SEQ ID NO: 3403323 - protein, 25 aa, Plasmodium falciparum
ENFYQTCPYNWIFKDNKCIAPYYYV

SEQ ID NO: 3403324 - protein, 18 aa, Plasmodium falciparum
ENIGRILTRSSSQQKDIH

SEQ ID NO: 3403325 - protein, 25 aa, Plasmodium falciparum
ENKEFDFSKNYNFSSKNDGGVTMFS

SEQ ID NO: 3403326 - protein, 17 aa, Plasmodium falciparum
ENLFKFVKCEYCNEHTY

SEQ ID NO: 3403327 - protein, 19 aa, Plasmodium falciparum
ENRNVWLRRILNNERKRSV

SEQ ID NO: 3403328 - protein, 23 aa, Plasmodium falciparum
ENRRFPLKNIYIFKNGKHANIYG

SEQ ID NO: 3403329 - protein, 23 aa, Plasmodium falciparum
ENSRSQLFKGLDKTLDYLSFLPK

SEQ ID NO: 3403330 - protein, 19 aa, Plasmodium falciparum
ENTLILKWKVYGETKDTTE

SEQ ID NO: 3403331 - protein, 21 aa, Plasmodium falciparum
ENVILLKFYFRSDLETLLSNL

SEQ ID NO: 3403332 - protein, 19 aa, Plasmodium falciparum
ENWSIACEAYWPCYTDCIS

SEQ ID NO: 3403333 - protein, 20 aa, Plasmodium falciparum
ENYFIYNFLSSYKLDILKEY

SEQ ID NO: 3403334 - protein, 26 aa, Plasmodium falciparum
EPKVLCSKIPLLLINGCSGIAVSILS

SEQ ID NO: 3403335 - protein, 21 aa, Plasmodium falciparum
EPNHPFPFGWLDNRMSTRTSL

SEQ ID NO: 3403336 - protein, 19 aa, Plasmodium falciparum
EPQSRAIIKYVDLQDKNFA

SEQ ID NO: 3403337 - protein, 19 aa, Plasmodium falciparum
EPVLSKVLYNEILFENIKI

SEQ ID NO: 3403338 - protein, 26 aa, Plasmodium falciparum
EQEIKNKCIFNWDIGKETLLKMFDMS

SEQ ID NO: 3403339 - protein, 21 aa, Plasmodium falciparum
EQKRNISFIYVLNMLSTFYKI

SEQ ID NO: 3403340 - protein, 22 aa, Plasmodium falciparum
EQQKECLKNMGVLDLELNDTQC

SEQ ID NO: 3403341 - protein, 19 aa, Plasmodium falciparum
ERICCDEESYVIFDTGTSY

SEQ ID NO: 3403342 - protein, 21 aa, Plasmodium falciparum
ERKRSSLLDAIYGYQKKWKEV

SEQ ID NO: 3403343 - protein, 20 aa, Plasmodium falciparum
ERKYLYLINGLPWPFKSQDT

SEQ ID NO: 3403344 - protein, 17 aa, Plasmodium falciparum
ERLPLNFIKNDLYEIKR

SEQ ID NO: 3403345 - protein, 19 aa, Plasmodium falciparum
ERNQKILLIHLLKNIKELL

SEQ ID NO: 3403346 - protein, 24 aa, Plasmodium falciparum
ERNVAGSFSRFFSKLNPFKKDEVI

SEQ ID NO: 3403347 - protein, 44 aa, Plasmodium falciparum
ERPLFSKIIYCYNFKRELYIYYNRLSWFTYQMMKMQHEDDLSDD

SEQ ID NO: 3403348 - protein, 25 aa, Plasmodium falciparum
ESFLGIKKWKYLGISTAYKIVGEGK

SEQ ID NO: 3403349 - protein, 22 aa, Plasmodium falciparum
ESGKYKQLFDINKFFKKEIEGH

SEQ ID NO: 3403350 - protein, 25 aa, Plasmodium falciparum
ESSNLKYLWRIPIINNLYNLCCKDK

SEQ ID NO: 3403351 - protein, 35 aa, Plasmodium falciparum
ESVRSYIKRELKDCLDVNTSAYIFKLSEFYSKNVL

SEQ ID NO: 3403352 - protein, 26 aa, Plasmodium falciparum
ETDIKITLKYCPFCPPHKYKYDNMYK

SEQ ID NO: 3403353 - protein, 22 aa, Plasmodium falciparum
ETHPEYSFEMLNDFKKELSSKK

SEQ ID NO: 3403354 - protein, 17 aa, Plasmodium falciparum
ETNIYLPSILKNFKNIY

SEQ ID NO: 3403355 - protein, 20 aa, Plasmodium falciparum
ETSKKLWFDLLYAYDKFGWF

SEQ ID NO: 3403356 - protein, 24 aa, Plasmodium falciparum
ETSPGSCFWLPHGSKIYNKLIEFI

SEQ ID NO: 3403357 - protein, 18 aa, Plasmodium falciparum
ETVKCFRNIYAASSQLQD

SEQ ID NO: 3403358 - protein, 25 aa, Plasmodium falciparum
ETVVSYDVPYTWGIMVSPQEGFSYI

SEQ ID NO: 3403359 - protein, 27 aa, Plasmodium falciparum
ETYLLKYYLSALISFVPFIKPAMKIYY

SEQ ID NO: 3403360 - protein, 18 aa, Plasmodium falciparum
ETYYKKIFNAIFEQIDKL

SEQ ID NO: 3403361 - protein, 20 aa, Plasmodium falciparum
EVIISLPTPTTFLLFVQPSD

SEQ ID NO: 3403362 - protein, 21 aa, Plasmodium falciparum
EVKQRLRGLAQSYIYNPDESK

SEQ ID NO: 3403363 - protein, 18 aa, Plasmodium falciparum
EVLLKGKMGKYFIGNNKN

SEQ ID NO: 3403364 - protein, 23 aa, Plasmodium falciparum
EVLSCLKPVFKKDNVYIGVLENI

SEQ ID NO: 3403365 - protein, 19 aa, Plasmodium falciparum
EWSGFPTIFFVKAGSKIPL

SEQ ID NO: 3403366 - protein, 24 aa, Plasmodium falciparum
EYDAAFNGIGPWPSTEELIKHQNN

SEQ ID NO: 3403367 - protein, 22 aa, Plasmodium falciparum
EYDIIKNLIIMFGQEDNKSKNG

SEQ ID NO: 3403368 - protein, 23 aa, Plasmodium falciparum
EYKKFSLKPSLVFDDNNNDIKVI

SEQ ID NO: 3403369 - protein, 26 aa, Plasmodium falciparum
EYKMLLNACRYCWRYLKRKLHDSCED

SEQ ID NO: 3403370 - protein, 24 aa, Plasmodium falciparum
EYNRICSRNKLNFHNIQTDNTIYK

SEQ ID NO: 3403371 - protein, 17 aa, Plasmodium falciparum
EYTFFFPGQGEQYMSMG

SEQ ID NO: 3403372 - protein, 23 aa, Plasmodium falciparum
EYYHRAFRIPSHLSDINVSNNYP

SEQ ID NO: 3403373 - protein, 26 aa, Plasmodium falciparum
FAEGEIEFKCLIYIPSKAPSMNDQLY

SEQ ID NO: 3403374 - protein, 23 aa, Plasmodium falciparum
FANPHISHIILYWKSNNIMEEII

SEQ ID NO: 3403375 - protein, 19 aa, Plasmodium falciparum
FARAFSVYLLHFYAKDLKM

SEQ ID NO: 3403376 - protein, 20 aa, Plasmodium falciparum
FCIFLFFNVVLSKLDFANEQ

SEQ ID NO: 3403377 - protein, 22 aa, Plasmodium falciparum
FCLLFQYLCIFQNKVSTNDITK

SEQ ID NO: 3403378 - protein, 19 aa, Plasmodium falciparum
FCSLLKLVDLSGTFMNHQI

SEQ ID NO: 3403379 - protein, 17 aa, Plasmodium falciparum
FCSWILIKGYIINKNEV

SEQ ID NO: 3403380 - protein, 21 aa, Plasmodium falciparum
FCYGGIPLACSNLMKYDNVFD

SEQ ID NO: 3403381 - protein, 23 aa, Plasmodium falciparum
FDKKYKIVQIFDELINCPNIILN

SEQ ID NO: 3403382 - protein, 21 aa, Plasmodium falciparum
FDKNFLFPSLNSGIILDITLL

SEQ ID NO: 3403383 - protein, 17 aa, Plasmodium falciparum
FDLCKRKKISIENMTRK

SEQ ID NO: 3403384 - protein, 18 aa, Plasmodium falciparum
FEDMLKGKVDDMDIGKMM

SEQ ID NO: 3403385 - protein, 18 aa, Plasmodium falciparum
FEELKLSFNIIKKRKKDK

SEQ ID NO: 3403386 - protein, 22 aa, Plasmodium falciparum
FEELRKPITIELLDGSIKSGES

SEQ ID NO: 3403387 - protein, 26 aa, Plasmodium falciparum
FEERHGKGKIPFRRNFDETKEDGQKG

SEQ ID NO: 3403388 - protein, 25 aa, Plasmodium falciparum
FENSELKSLITALGLNVNYDNKNLK

SEQ ID NO: 3403389 - protein, 23 aa, Plasmodium falciparum
FEPNLLSSIYFKALQAKLSDEEA

SEQ ID NO: 3403390 - protein, 19 aa, Plasmodium falciparum
FFCSFLIWVNTMNPGRQGN

SEQ ID NO: 3403391 - protein, 20 aa, Plasmodium falciparum
FFFCSPCYAYNFSKVKQTFL

SEQ ID NO: 3403392 - protein, 23 aa, Plasmodium falciparum
FFFFFCFYFEISFCENDKKEELF

SEQ ID NO: 3403393 - protein, 18 aa, Plasmodium falciparum
FFFLFFVLCVIQENVRRV

SEQ ID NO: 3403394 - protein, 23 aa, Plasmodium falciparum
FFFSFFLLKALNFVSMVYDEEGK

SEQ ID NO: 3403395 - protein, 17 aa, Plasmodium falciparum
FFGYAFALFCTVCCFSK

SEQ ID NO: 3403396 - protein, 19 aa, Plasmodium falciparum
FFILYSLFMTCLTKKMLFI

SEQ ID NO: 3403397 - protein, 17 aa, Plasmodium falciparum
FFLFFCFFLQQKNILCS

SEQ ID NO: 3403398 - protein, 18 aa, Plasmodium falciparum
FFLLFFVYKNTNTVVCDN

SEQ ID NO: 3403399 - protein, 21 aa, Plasmodium falciparum
FFLLSCIVHLSRCSDNNSYSF

SEQ ID NO: 3403400 - protein, 25 aa, Plasmodium falciparum
FFLTECNIYWSFCVILKTKNPAFLP

SEQ ID NO: 3403401 - protein, 22 aa, Plasmodium falciparum
FFNELLNLFLIENVGILSTLEE

SEQ ID NO: 3403402 - protein, 19 aa, Plasmodium falciparum
FFNKSRCDNELSVKGSLTV

SEQ ID NO: 3403403 - protein, 30 aa, Plasmodium falciparum
FFSFVCLFFRVLSCEGIHEKKKINLKIELI

SEQ ID NO: 3403404 - protein, 18 aa, Plasmodium falciparum
FFSLVFLVLLLLLSIKTN

SEQ ID NO: 3403405 - protein, 27 aa, Plasmodium falciparum
FFSYKGKFIPINAFITLENKINYIFFN

SEQ ID NO: 3403406 - protein, 19 aa, Plasmodium falciparum
FFTKEEFSYEQQIFNILQQ

SEQ ID NO: 3403407 - protein, 21 aa, Plasmodium falciparum
FFVFLPFSFCYIRNNDNRFVY

SEQ ID NO: 3403408 - protein, 17 aa, Plasmodium falciparum
FGILSLDKVLVVYEEQK

SEQ ID NO: 3403409 - protein, 19 aa, Plasmodium falciparum
FGMFYNIFRKKRCIKNLRT

SEQ ID NO: 3403410 - protein, 17 aa, Plasmodium falciparum
FHHCAIAEPERNKKYSI

SEQ ID NO: 3403411 - protein, 18 aa, Plasmodium falciparum
FHLDKFGILSLDKVLVVY

SEQ ID NO: 3403412 - protein, 19 aa, Plasmodium falciparum
FHVVKNVKNKSCFLNTFGV

SEQ ID NO: 3403413 - protein, 19 aa, Plasmodium falciparum
FIDEFFSYYNIHVNFTDEE

SEQ ID NO: 3403414 - protein, 26 aa, Plasmodium falciparum
FIDFIKECRNRLSLIRSQLKDKCEKK

SEQ ID NO: 3403415 - protein, 18 aa, Plasmodium falciparum
FIFYFPSEKFTFYESVFT

SEQ ID NO: 3403416 - protein, 17 aa, Plasmodium falciparum
FIKELLSAATNDEHVNT

SEQ ID NO: 3403417 - protein, 19 aa, Plasmodium falciparum
FILCVIFNKNVIKCTGESQ

SEQ ID NO: 3403418 - protein, 18 aa, Plasmodium falciparum
FINWPKAECTLFLLQNEV

SEQ ID NO: 3403419 - protein, 29 aa, Plasmodium falciparum
FIRYRKVLRWSRMWWVLLVREIVGDNTIE

SEQ ID NO: 3403420 - protein, 20 aa, Plasmodium falciparum
FISTFSWKSILSYRRLKDIN

SEQ ID NO: 3403421 - protein, 19 aa, Plasmodium falciparum
FISTPFKGSVKTIRALIQS

SEQ ID NO: 3403422 - protein, 20 aa, Plasmodium falciparum
FIYSYFLSYNHHFFDKHKYL

SEQ ID NO: 3403423 - protein, 19 aa, Plasmodium falciparum
FKEPWILNHGKTFNENNYE

SEQ ID NO: 3403424 - protein, 22 aa, Plasmodium falciparum
FKFLCLTVCLILTIYSSRNEIH

SEQ ID NO: 3403425 - protein, 20 aa, Plasmodium falciparum
FKFVKCEYCNEHTYVKGKKA

SEQ ID NO: 3403426 - protein, 20 aa, Plasmodium falciparum
FKGFLRKYLYEIKKHKSCSS

SEQ ID NO: 3403427 - protein, 19 aa, Plasmodium falciparum
FKKHFNLTCSLDLSDFQQE

SEQ ID NO: 3403428 - protein, 23 aa, Plasmodium falciparum
FKKKLVTCLSLLQVGDPLKIIVD

SEQ ID NO: 3403429 - protein, 21 aa, Plasmodium falciparum
FKKYICETLGKGFKCGFNGLL

SEQ ID NO: 3403430 - protein, 17 aa, Plasmodium falciparum
FKLKSDMICYNSNSDNL

SEQ ID NO: 3403431 - protein, 20 aa, Plasmodium falciparum
FKLLGLYGSNSINWLVTDMG

SEQ ID NO: 3403432 - protein, 21 aa, Plasmodium falciparum
FKLNESMKNHFYNIFVKETVM

SEQ ID NO: 3403433 - protein, 17 aa, Plasmodium falciparum
FKLYNSREMKNLCETSR

SEQ ID NO: 3403434 - protein, 20 aa, Plasmodium falciparum
FKNICIRAGHHCASLLHKYY

SEQ ID NO: 3403435 - protein, 22 aa, Plasmodium falciparum
FKNKRITMILGRKVYLNTLSKN

SEQ ID NO: 3403436 - protein, 24 aa, Plasmodium falciparum
FKNYERAENIAFLLRQSEQKILVE

SEQ ID NO: 3403437 - protein, 21 aa, Plasmodium falciparum
FKYELFLSTRPKKFIGQISTW

SEQ ID NO: 3403438 - protein, 26 aa, Plasmodium falciparum
FKYSHELLTYIFFVINLFKHEQFKNK

SEQ ID NO: 3403439 - protein, 17 aa, Plasmodium falciparum
FKYVFNYEQLAFLKCEN

SEQ ID NO: 3403440 - protein, 18 aa, Plasmodium falciparum
FLCIIIKIKYASSGEGIF

SEQ ID NO: 3403441 - protein, 18 aa, Plasmodium falciparum
FLCIILLLLLIYKCTHSY

SEQ ID NO: 3403442 - protein, 18 aa, Plasmodium falciparum
FLCNLYETHPEYSFEMLN

SEQ ID NO: 3403443 - protein, 17 aa, Plasmodium falciparum
FLFFSFVYISNIKCVEE

SEQ ID NO: 3403444 - protein, 18 aa, Plasmodium falciparum
FLFYPSCHDESAIFYLIF

SEQ ID NO: 3403445 - protein, 18 aa, Plasmodium falciparum
FLIILVLLKCVLSYNLNN

SEQ ID NO: 3403446 - protein, 17 aa, Plasmodium falciparum
FLIKLCVCHTEKGVKKE

SEQ ID NO: 3403447 - protein, 17 aa, Plasmodium falciparum
FLKNRTRRLYKGREKIK

SEQ ID NO: 3403448 - protein, 17 aa, Plasmodium falciparum
FLKRKKKGIKLFKNKKN

SEQ ID NO: 3403449 - protein, 22 aa, Plasmodium falciparum
FLLEKISLITFVEDLCSLFDTD

SEQ ID NO: 3403450 - protein, 19 aa, Plasmodium falciparum
FLLFLFWKKGYSIKKGIKR

SEQ ID NO: 3403451 - protein, 17 aa, Plasmodium falciparum
FLLFLINIYICEANGTL

SEQ ID NO: 3403452 - protein, 21 aa, Plasmodium falciparum
FLNNKSCWRYKDKGNEYERKL

SEQ ID NO: 3403453 - protein, 23 aa, Plasmodium falciparum
FLPIFFFVLIWYVHYVLGQPSDV

SEQ ID NO: 3403454 - protein, 22 aa, Plasmodium falciparum
FLTIDIRFLFYPSCHDESAIFY

SEQ ID NO: 3403455 - protein, 23 aa, Plasmodium falciparum
FLVICLLCCLLSTYVSVIEGHRA

SEQ ID NO: 3403456 - protein, 31 aa, Plasmodium falciparum
FLVKYINNIWINKNVHKYFYFLNSLYDRMRK

SEQ ID NO: 3403457 - protein, 17 aa, Plasmodium falciparum
FLYSNKCFAPWPCKDNC

SEQ ID NO: 3403458 - protein, 21 aa, Plasmodium falciparum
FMKQKLRAERLRKIRIHMNTQ

SEQ ID NO: 3403459 - protein, 17 aa, Plasmodium falciparum
FMRNFFTVFVRGTESRP

SEQ ID NO: 3403460 - protein, 28 aa, Plasmodium falciparum
FMVATFFIWLWNEGHLWDKATASQDEIF

SEQ ID NO: 3403461 - protein, 17 aa, Plasmodium falciparum
FNCMKRKYDKKLSSSVV

SEQ ID NO: 3403462 - protein, 25 aa, Plasmodium falciparum
FNCNFKRLYDYIFYKHKINAYHKYR

SEQ ID NO: 3403463 - protein, 18 aa, Plasmodium falciparum
FNFIHSVVIFNVDLPMNN

SEQ ID NO: 3403464 - protein, 26 aa, Plasmodium falciparum
FNFSKKYEIQRFKGLGEMMADQLWNT

SEQ ID NO: 3403465 - protein, 18 aa, Plasmodium falciparum
FNGIFIFDMMYQYIGTTE

SEQ ID NO: 3403466 - protein, 27 aa, Plasmodium falciparum
FNGYKRSGDYAWSFFWHHFNYDKDTDY

SEQ ID NO: 3403467 - protein, 19 aa, Plasmodium falciparum
FNILDFLYYIPLRSRFSSL

SEQ ID NO: 3403468 - protein, 26 aa, Plasmodium falciparum
FNKENLPLFIFANWRGFSGGSMDMFY

SEQ ID NO: 3403469 - protein, 18 aa, Plasmodium falciparum
FNKTCVYNTYVIEESYIK

SEQ ID NO: 3403470 - protein, 39 aa, Plasmodium falciparum
FNLNIINEYPLREWILVTFHYIKGMITLQNIKFIIKSLD

SEQ ID NO: 3403471 - protein, 25 aa, Plasmodium falciparum
FNLQKEIFYRLSLVIYNLNKKDKIN

SEQ ID NO: 3403472 - protein, 24 aa, Plasmodium falciparum
FNNFKSSFYFHMFILDKLKKQIHV

SEQ ID NO: 3403473 - protein, 17 aa, Plasmodium falciparum
FNNFLSFLSENYQSYEK

SEQ ID NO: 3403474 - protein, 22 aa, Plasmodium falciparum
FNNIKNFFFFSSNDKKEQKENN

SEQ ID NO: 3403475 - protein, 22 aa, Plasmodium falciparum
FNNIRMFINFYLNIKKVKSKDI

SEQ ID NO: 3403476 - protein, 20 aa, Plasmodium falciparum
FNNLKRLLIYHSEENINTLK

SEQ ID NO: 3403477 - protein, 21 aa, Plasmodium falciparum
FNYLSPNAFGFSSYKDDISLS

SEQ ID NO: 3403478 - protein, 25 aa, Plasmodium falciparum
FPKRGEGRYLFGRNQMKSQDIEKNN

SEQ ID NO: 3403479 - protein, 17 aa, Plasmodium falciparum
FPLEILKHYYKKTMEKK

SEQ ID NO: 3403480 - protein, 25 aa, Plasmodium falciparum
FPLRRGIRDFDDFYSILVNYRKNEK

SEQ ID NO: 3403481 - protein, 20 aa, Plasmodium falciparum
FPNNKVNTFVSNKTNVNMNN

SEQ ID NO: 3403482 - protein, 19 aa, Plasmodium falciparum
FPNSKKCKKGHINHECSNN

SEQ ID NO: 3403483 - protein, 27 aa, Plasmodium falciparum
FPRNIDFSVKLIREGKDGLCNFLSGVL

SEQ ID NO: 3403484 - protein, 21 aa, Plasmodium falciparum
FPSLNSGIILDITLLKNIYEV

SEQ ID NO: 3403485 - protein, 26 aa, Plasmodium falciparum
FPYTYYNPYYMFRLTNNFKENDEGLK

SEQ ID NO: 3403486 - protein, 25 aa, Plasmodium falciparum
FQKDQKCYLAWSFNSLNINDEITKE

SEQ ID NO: 3403487 - protein, 17 aa, Plasmodium falciparum
FQLPVRFNLQYKNKEYV

SEQ ID NO: 3403488 - protein, 21 aa, Plasmodium falciparum
FQSLCKKVSVSETCLYNIQKF

SEQ ID NO: 3403489 - protein, 23 aa, Plasmodium falciparum
FRAQFKGAIRFIKDLTTTYMEEE

SEQ ID NO: 3403490 - protein, 18 aa, Plasmodium falciparum
FRLLGLYGNNSTNWLITD

SEQ ID NO: 3403491 - protein, 20 aa, Plasmodium falciparum
FRLLGLYGSNSINWIAADMA

SEQ ID NO: 3403492 - protein, 25 aa, Plasmodium falciparum
FRSLLEFKKYPSVVVFNPYKRIRYA

SEQ ID NO: 3403493 - protein, 20 aa, Plasmodium falciparum
FRSWLQKYMEVTRELKEKFS

SEQ ID NO: 3403494 - protein, 17 aa, Plasmodium falciparum
FSFFFVYLYYVSCNQST

SEQ ID NO: 3403495 - protein, 17 aa, Plasmodium falciparum
FSGFACLSHFELKPNNC

SEQ ID NO: 3403496 - protein, 26 aa, Plasmodium falciparum
FSGGEFLWPGYTEELKAKKASEDAEK

SEQ ID NO: 3403497 - protein, 22 aa, Plasmodium falciparum
FSGQSISIFPIIGDDINRGHYE

SEQ ID NO: 3403498 - protein, 26 aa, Plasmodium falciparum
FSGTSYKRFVVDGASIFLRNPYKITL

SEQ ID NO: 3403499 - protein, 17 aa, Plasmodium falciparum
FSHHSCTDISGENLCGP

SEQ ID NO: 3403500 - protein, 20 aa, Plasmodium falciparum
FSKICNVKWLCVENSQRDYS

SEQ ID NO: 3403501 - protein, 21 aa, Plasmodium falciparum
FSLLLFVIRWNIISCNKNDKN

SEQ ID NO: 3403502 - protein, 19 aa, Plasmodium falciparum
FSNVLCFRGNNGHNSSSSL

SEQ ID NO: 3403503 - protein, 17 aa, Plasmodium falciparum
FTGKYSHLFTYSKKPLP

SEQ ID NO: 3403504 - protein, 21 aa, Plasmodium falciparum
FTGSGNLGIECISRDVKNVTF

SEQ ID NO: 3403505 - protein, 22 aa, Plasmodium falciparum
FTNKIFMSGRVQLKSTKLQHRK

SEQ ID NO: 3403506 - protein, 19 aa, Plasmodium falciparum
FTSTHLVKFFIFNKNHSAD

SEQ ID NO: 3403507 - protein, 18 aa, Plasmodium falciparum
FVALLAGLIKKKVECIEL

SEQ ID NO: 3403508 - protein, 26 aa, Plasmodium falciparum
FVKNKLRFVSPYVYTYKLFSKKRWVG

SEQ ID NO: 3403509 - protein, 25 aa, Plasmodium falciparum
FVLYFKDDILTIKWKVYEEKSATPQ

SEQ ID NO: 3403510 - protein, 17 aa, Plasmodium falciparum
FVNHLKYIYPTAENVDH

SEQ ID NO: 3403511 - protein, 25 aa, Plasmodium falciparum
FVQKDYWLKGTIPFLESMVFNSNVS

SEQ ID NO: 3403512 - protein, 20 aa, Plasmodium falciparum
FYCEKIMKAKEIERLDDTSS

SEQ ID NO: 3403513 - protein, 18 aa, Plasmodium falciparum
FYCFCNLDTVTIQKFLKI

SEQ ID NO: 3403514 - protein, 18 aa, Plasmodium falciparum
FYCIFKNTVLLQRTNDIP

SEQ ID NO: 3403515 - protein, 20 aa, Plasmodium falciparum
FYDENLIKIIVMATDEDIKS

SEQ ID NO: 3403516 - protein, 19 aa, Plasmodium falciparum
FYEKMYDIFPVLKSNHMMK

SEQ ID NO: 3403517 - protein, 22 aa, Plasmodium falciparum
FYIAVLFGLIFLNQNVCTQKGP

SEQ ID NO: 3403518 - protein, 18 aa, Plasmodium falciparum
FYIFLILNFSFFQSNATS

SEQ ID NO: 3403519 - protein, 23 aa, Plasmodium falciparum
FYLHFFKGKFYWCYYNEEADAKM

SEQ ID NO: 3403520 - protein, 24 aa, Plasmodium falciparum
FYLHLEEFFYILKHYVELRKIQDL

SEQ ID NO: 3403521 - protein, 18 aa, Plasmodium falciparum
FYLLPCFSQISFVDNIYA

SEQ ID NO: 3403522 - protein, 21 aa, Plasmodium falciparum
FYQIICFFLAHYNPYFTTNIV

SEQ ID NO: 3403523 - protein, 17 aa, Plasmodium falciparum
FYSSIVFLEQEYMLDET

SEQ ID NO: 3403524 - protein, 17 aa, Plasmodium falciparum
GAGKLFYATTLFDQQIK

SEQ ID NO: 3403525 - protein, 19 aa, Plasmodium falciparum
GASNLKDINIHNVEKKSNM

SEQ ID NO: 3403526 - protein, 20 aa, Plasmodium falciparum
GAYIYVCGNSNMSKDVNKTI

SEQ ID NO: 3403527 - protein, 24 aa, Plasmodium falciparum
GCASWYWEYPYHYAPLCSDLLSFE

SEQ ID NO: 3403528 - protein, 21 aa, Plasmodium falciparum
GCKYYKFIINTFIKPRRKTSF

SEQ ID NO: 3403529 - protein, 24 aa, Plasmodium falciparum
GDRFLYHMIRIIVGTLVQVGVGLL

SEQ ID NO: 3403530 - protein, 25 aa, Plasmodium falciparum
GDTYYKEYNCNILLDSCDFFLHTQS

SEQ ID NO: 3403531 - protein, 18 aa, Plasmodium falciparum
GDVLRYVKNKIIEDTNIS

SEQ ID NO: 3403532 - protein, 17 aa, Plasmodium falciparum
GEDEILFTIQLIMSKSG

SEQ ID NO: 3403533 - protein, 19 aa, Plasmodium falciparum
GELFGEVSYDCEYSGFLEI

SEQ ID NO: 3403534 - protein, 19 aa, Plasmodium falciparum
GELLVGVPKVFNRIYSNIM

SEQ ID NO: 3403535 - protein, 19 aa, Plasmodium falciparum
GENDWNEYEYFKLKSNELK

SEQ ID NO: 3403536 - protein, 23 aa, Plasmodium falciparum
GEPYKIFKNTAFVKNMFNSDLEV

SEQ ID NO: 3403537 - protein, 21 aa, Plasmodium falciparum
GEQIPIAVGLAYSILYKNEFH

SEQ ID NO: 3403538 - protein, 20 aa, Plasmodium falciparum
GEYTCLPSEDILNLLSQNKL

SEQ ID NO: 3403539 - protein, 20 aa, Plasmodium falciparum
GFHTRRCVAQLSLFSRKKRK

SEQ ID NO: 3403540 - protein, 23 aa, Plasmodium falciparum
GFIPEPKLEWELAARGFFAGYFD

SEQ ID NO: 3403541 - protein, 17 aa, Plasmodium falciparum
GGFQLKDIEALELIGSG

SEQ ID NO: 3403542 - protein, 20 aa, Plasmodium falciparum
GGKCRNNDNMLWLDLIKKNK

SEQ ID NO: 3403543 - protein, 41 aa, Plasmodium falciparum
GGKLQKFKRQRAFNILKQWRAKEKKLKEKKKKEEMEENKEF

SEQ ID NO: 3403544 - protein, 18 aa, Plasmodium falciparum
GGYDDFREIPGISNLLRH

SEQ ID NO: 3403545 - protein, 18 aa, Plasmodium falciparum
GHLDFVIIPHYTFLDYYK

SEQ ID NO: 3403546 - protein, 25 aa, Plasmodium falciparum
GHMFKSLEVILRYQRIYNDIKKGKE

SEQ ID NO: 3403547 - protein, 28 aa, Plasmodium falciparum
GHSLGGLYLNFFLSRVVSKKWKQKHLSK

SEQ ID NO: 3403548 - protein, 19 aa, Plasmodium falciparum
GIEDFFYTMFNKIIEEHPE

SEQ ID NO: 3403549 - protein, 18 aa, Plasmodium falciparum
GIKDEDWIMLPFEYEENK

SEQ ID NO: 3403550 - protein, 21 aa, Plasmodium falciparum
GISNILCKNINFGYHIKIKGV

SEQ ID NO: 3403551 - protein, 25 aa, Plasmodium falciparum
GKDAFDLYTSFGFPIDLIQIMCEEK

SEQ ID NO: 3403552 - protein, 22 aa, Plasmodium falciparum
GKDVQSLCAIKHGNVLIKNINE

SEQ ID NO: 3403553 - protein, 25 aa, Plasmodium falciparum
GKEVLLSIMLMWQIRRQSKIVEEKN

SEQ ID NO: 3403554 - protein, 24 aa, Plasmodium falciparum
GKIYLMKITKGIPFQLLTKTHISI

SEQ ID NO: 3403555 - protein, 23 aa, Plasmodium falciparum
GKLHFPYGFPRNIDFSVKLIREG

SEQ ID NO: 3403556 - protein, 27 aa, Plasmodium falciparum
GKLYSKKGFCIPNMIMPIDVLSEKDIK

SEQ ID NO: 3403557 - protein, 20 aa, Plasmodium falciparum
GKMKKFYSSIVFLEQEYMLD

SEQ ID NO: 3403558 - protein, 23 aa, Plasmodium falciparum
GKNPLSDMMNIFGVPQTGKEGAE

SEQ ID NO: 3403559 - protein, 19 aa, Plasmodium falciparum
GKQAAELLESIILKKKFVR

SEQ ID NO: 3403560 - protein, 17 aa, Plasmodium falciparum
GKTSLFDYICKTNEQKK

SEQ ID NO: 3403561 - protein, 23 aa, Plasmodium falciparum
GKWAKELGILAINFEGYFQNSPL

SEQ ID NO: 3403562 - protein, 39 aa, Plasmodium falciparum
GLLASLTCGLCCYLYSYCYNGRFFKNGRGSNRNNKKRSI

SEQ ID NO: 3403563 - protein, 24 aa, Plasmodium falciparum
GLLLRKFHMDDMVWGIPMEVLITR

SEQ ID NO: 3403564 - protein, 19 aa, Plasmodium falciparum
GLLRKGRKRKRRRNKRTRR

SEQ ID NO: 3403565 - protein, 19 aa, Plasmodium falciparum
GNCVTCSSNSITVSHVIKK

SEQ ID NO: 3403566 - protein, 17 aa, Plasmodium falciparum
GNEVYYFPGKVTRVRAK

SEQ ID NO: 3403567 - protein, 17 aa, Plasmodium falciparum
GNEYIKVSIVSPGKGFN

SEQ ID NO: 3403568 - protein, 24 aa, Plasmodium falciparum
GNILKICLNKSISFITKRYHTKHK

SEQ ID NO: 3403569 - protein, 20 aa, Plasmodium falciparum
GNLGNLLAPLLKGIKSNLFS

SEQ ID NO: 3403570 - protein, 17 aa, Plasmodium falciparum
GNRITPSYVSFVDGERK

SEQ ID NO: 3403571 - protein, 22 aa, Plasmodium falciparum
GNVPELKARIFSEEENTEVESA

SEQ ID NO: 3403572 - protein, 23 aa, Plasmodium falciparum
GNYGEANFSFFQATPASHIEEPQ

SEQ ID NO: 3403573 - protein, 25 aa, Plasmodium falciparum
GQLKYLKTCREIFRTLNEAIVDLNI

SEQ ID NO: 3403574 - protein, 18 aa, Plasmodium falciparum
GRAKEGIITDEKRRSSTK

SEQ ID NO: 3403575 - protein, 19 aa, Plasmodium falciparum
GRDLWKLNSKNQIYNPINN

SEQ ID NO: 3403576 - protein, 19 aa, Plasmodium falciparum
GRDSWELIEAELLNGQKLQ

SEQ ID NO: 3403577 - protein, 23 aa, Plasmodium falciparum
GRDYNSVCPINWIDIGKGLCRNI

SEQ ID NO: 3403578 - protein, 17 aa, Plasmodium falciparum
GRIKRLINNFDLKMKKG

SEQ ID NO: 3403579 - protein, 17 aa, Plasmodium falciparum
GRLRSNNGMCLKTYKNI

SEQ ID NO: 3403580 - protein, 27 aa, Plasmodium falciparum
GRYIEVLKKEGWRDQIYLYWSSKISID

SEQ ID NO: 3403581 - protein, 26 aa, Plasmodium falciparum
GSFYDFKLKMGDLITSNFESTVVHNN

SEQ ID NO: 3403582 - protein, 19 aa, Plasmodium falciparum
GSIEVLKNCMLKLQKEDSI

SEQ ID NO: 3403583 - protein, 21 aa, Plasmodium falciparum
GSKNITCFYPIVGKKERKTLD

SEQ ID NO: 3403584 - protein, 20 aa, Plasmodium falciparum
GSKRGGSCGRGMKGQKSRSG

SEQ ID NO: 3403585 - protein, 19 aa, Plasmodium falciparum
GSMDMFYGILKFGSMIVNQ

SEQ ID NO: 3403586 - protein, 18 aa, Plasmodium falciparum
GSPGRGEHAHGFHFDQDV

SEQ ID NO: 3403587 - protein, 25 aa, Plasmodium falciparum
GSSILFKNFFGMPFLKNDNDVNLST

SEQ ID NO: 3403588 - protein, 20 aa, Plasmodium falciparum
GSVCSEGWVKEAENIVCHEL

SEQ ID NO: 3403589 - protein, 26 aa, Plasmodium falciparum
GSYAFLRYKSFYDFVFSTYVNIKGVG

SEQ ID NO: 3403590 - protein, 26 aa, Plasmodium falciparum
GSYILYRYTKLYKGFISLDIKLPYEG

SEQ ID NO: 3403591 - protein, 24 aa, Plasmodium falciparum
GTKEEVKILFGLKAIKINGNTIDD

SEQ ID NO: 3403592 - protein, 23 aa, Plasmodium falciparum
GTSMRKAREGSLLNSNERENDIN

SEQ ID NO: 3403593 - protein, 24 aa, Plasmodium falciparum
GTTEIGYIIKIFLENNISSENIPS

SEQ ID NO: 3403594 - protein, 21 aa, Plasmodium falciparum
GVGSVGLIFRSYDKYNFYMLE

SEQ ID NO: 3403595 - protein, 18 aa, Plasmodium falciparum
GVIEFTLPPVVHKATVFY

SEQ ID NO: 3403596 - protein, 24 aa, Plasmodium falciparum
GVKITGSCGVQFQLVIVPHLFIYV

SEQ ID NO: 3403597 - protein, 17 aa, Plasmodium falciparum
GVWDEWSPCSVTCGKGT

SEQ ID NO: 3403598 - protein, 18 aa, Plasmodium falciparum
GWGHSSENPLLSTLLEKE

SEQ ID NO: 3403599 - protein, 21 aa, Plasmodium falciparum
GWIRKENACSRVESITECSSI

SEQ ID NO: 3403600 - protein, 19 aa, Plasmodium falciparum
GYIPLRRWTNVIITLNNKE

SEQ ID NO: 3403601 - protein, 21 aa, Plasmodium falciparum
GYPFLVGKHMYEYGIIPEQYM

SEQ ID NO: 3403602 - protein, 25 aa, Plasmodium falciparum
HDFEVWKNKFFMQLPKLLNMKNIPI

SEQ ID NO: 3403603 - protein, 25 aa, Plasmodium falciparum
HDIMKLQLFFTMAFKDCNVNQNFTE

SEQ ID NO: 3403604 - protein, 27 aa, Plasmodium falciparum
HDMSTCMKAKGVIRKIVPWNKARSFFY

SEQ ID NO: 3403605 - protein, 30 aa, Plasmodium falciparum
HDYGEAFFFLAEIILDISMRKQYISDYVYE

SEQ ID NO: 3403606 - protein, 22 aa, Plasmodium falciparum
HDYSVLCPDEWIEGNDGYCFPT

SEQ ID NO: 3403607 - protein, 21 aa, Plasmodium falciparum
HEERPRTVLKQIPANISCCPI

SEQ ID NO: 3403608 - protein, 23 aa, Plasmodium falciparum
HEHYEKYYFLKYGQFDYNFNEKI

SEQ ID NO: 3403609 - protein, 25 aa, Plasmodium falciparum
HENLKVGDIFFCRFENVKRQSIRNV

SEQ ID NO: 3403610 - protein, 18 aa, Plasmodium falciparum
HGILKFKKPCDATLVLLN

SEQ ID NO: 3403611 - protein, 17 aa, Plasmodium falciparum
HHTFFEMLGNWSFGDYF

SEQ ID NO: 3403612 - protein, 22 aa, Plasmodium falciparum
HIKNIIENVSFFKPEQNYEQTK

SEQ ID NO: 3403613 - protein, 20 aa, Plasmodium falciparum
HIKRPSCVLYAVKRKKKKNP

SEQ ID NO: 3403614 - protein, 22 aa, Plasmodium falciparum
HIYERVLVHILFMLGGTINIWS

SEQ ID NO: 3403615 - protein, 30 aa, Plasmodium falciparum
HKIPKDIFPFILQLSLAFKYEHTHILINAP

SEQ ID NO: 3403616 - protein, 31 aa, Plasmodium falciparum
HKKKRLVDCNLCMLKHKFRLSFWKKRYDERP

SEQ ID NO: 3403617 - protein, 19 aa, Plasmodium falciparum
HKLSMWVYFIYNHFSSADE

SEQ ID NO: 3403618 - protein, 21 aa, Plasmodium falciparum
HKPGKYFIVYSYYRPFDPTRD

SEQ ID NO: 3403619 - protein, 19 aa, Plasmodium falciparum
HKSIRYKVMDILKSHDQFD

SEQ ID NO: 3403620 - protein, 26 aa, Plasmodium falciparum
HKVCTVYGLEFVKSYELIRVIISDIF

SEQ ID NO: 3403621 - protein, 25 aa, Plasmodium falciparum
HLEEISYPWNIYGGMSYYFSSENNS

SEQ ID NO: 3403622 - protein, 25 aa, Plasmodium falciparum
HLPIKLVSHSSCFRTEKNNTYGKTS

SEQ ID NO: 3403623 - protein, 20 aa, Plasmodium falciparum
HLSKIIFISTPFKGSVKTIR

SEQ ID NO: 3403624 - protein, 17 aa, Plasmodium falciparum
HNFLLDYHFNSIFEKEI

SEQ ID NO: 3403625 - protein, 24 aa, Plasmodium falciparum
HNKCPDENFCKGIKNVLSCPPKNS

SEQ ID NO: 3403626 - protein, 26 aa, Plasmodium falciparum
HNNKCKKIYFLPLIFLKNNNKDVYIE

SEQ ID NO: 3403627 - protein, 24 aa, Plasmodium falciparum
HNVNASMLWTLKRKTMQQFTEKYN

SEQ ID NO: 3403628 - protein, 17 aa, Plasmodium falciparum
HPELKEEIYFDDNYNDE

SEQ ID NO: 3403629 - protein, 18 aa, Plasmodium falciparum
HQLKCCDRGFSYKYNGIL

SEQ ID NO: 3403630 - protein, 23 aa, Plasmodium falciparum
HRLDKLTSGIVFFGKNKKFSTYF

SEQ ID NO: 3403631 - protein, 17 aa, Plasmodium falciparum
HSFIHKNNVYDIYNHIH

SEQ ID NO: 3403632 - protein, 45 aa, Plasmodium falciparum
HSSGIFLHSFRYTWTNIFDVFTLLPKWCQAFYLPQTLIAFLLYGD

SEQ ID NO: 3403633 - protein, 30 aa, Plasmodium falciparum
HTINSLKKGWSLPICKHLHLSYENMSFNNI

SEQ ID NO: 3403634 - protein, 25 aa, Plasmodium falciparum
HTMKIAPYLSRPVSILMPIYKYWQV

SEQ ID NO: 3403635 - protein, 18 aa, Plasmodium falciparum
HVCDFSKNNLIVPESLKK

SEQ ID NO: 3403636 - protein, 24 aa, Plasmodium falciparum
HVDALKYAVSRCVNYNIKKNEMIK

SEQ ID NO: 3403637 - protein, 21 aa, Plasmodium falciparum
HVETFLYPYFETLNMELNEAG

SEQ ID NO: 3403638 - protein, 20 aa, Plasmodium falciparum
HVGQIKLGYIYDIKDNDIYV

SEQ ID NO: 3403639 - protein, 38 aa, Plasmodium falciparum
HVQYLVTLCGIYKPECYRNRADVNLKVYTLKNWHELLD

SEQ ID NO: 3403640 - protein, 23 aa, Plasmodium falciparum
HVYERILVYLSFMKGIRIDIWSK

SEQ ID NO: 3403641 - protein, 18 aa, Plasmodium falciparum
HYYVVFILLYLYDISCFK

SEQ ID NO: 3403642 - protein, 19 aa, Plasmodium falciparum
IACEAYWPCYTDCISEEYI

SEQ ID NO: 3403643 - protein, 17 aa, Plasmodium falciparum
IAESTLWINNIRQGMDY

SEQ ID NO: 3403644 - protein, 17 aa, Plasmodium falciparum
IAGGIAGGLALLACAGL

SEQ ID NO: 3403645 - protein, 28 aa, Plasmodium falciparum
IAGGLALLACAGLAYKFVVPGAATPYAG

SEQ ID NO: 3403646 - protein, 19 aa, Plasmodium falciparum
IANELSVLLNINYYQGYGL

SEQ ID NO: 3403647 - protein, 19 aa, Plasmodium falciparum
IAYIYKDILVFKWKVYEEG

SEQ ID NO: 3403648 - protein, 20 aa, Plasmodium falciparum
ICGALKNVIALGVGFIDGLT

SEQ ID NO: 3403649 - protein, 24 aa, Plasmodium falciparum
ICIFFIPYFCRASFKEYLSNKKIF

SEQ ID NO: 3403650 - protein, 18 aa, Plasmodium falciparum
ICISLIFVFIKRSLGLYT

SEQ ID NO: 3403651 - protein, 21 aa, Plasmodium falciparum
ICLCMSMGLSNMFREHNVITP

SEQ ID NO: 3403652 - protein, 30 aa, Plasmodium falciparum
ICLCSLILIRTYSALSLKGIKEGDPPRLMY

SEQ ID NO: 3403653 - protein, 17 aa, Plasmodium falciparum
ICLVTLNLFILEINAKT

SEQ ID NO: 3403654 - protein, 18 aa, Plasmodium falciparum
ICSLSCTVLWVTAISSII

SEQ ID NO: 3403655 - protein, 26 aa, Plasmodium falciparum
ICTLNLLINSFFCYGGKVKKNKHLRN

SEQ ID NO: 3403656 - protein, 17 aa, Plasmodium falciparum
IDERINVLKKEYEETTS

SEQ ID NO: 3403657 - protein, 18 aa, Plasmodium falciparum
IDGIEKCWFNITDYLISE

SEQ ID NO: 3403658 - protein, 23 aa, Plasmodium falciparum
IDIEKCYQCSLLVENDSKSDVCY

SEQ ID NO: 3403659 - protein, 21 aa, Plasmodium falciparum
IDIKEPFYFMFGCNNNKGEGN

SEQ ID NO: 3403660 - protein, 29 aa, Plasmodium falciparum
IDIRYYLRGLFPFRPWIDVITKSDLINFD

SEQ ID NO: 3403661 - protein, 17 aa, Plasmodium falciparum
IDKFCWYGKKVQEHSEQ

SEQ ID NO: 3403662 - protein, 19 aa, Plasmodium falciparum
IDLPFLDLYIHCSGGTYIR

SEQ ID NO: 3403663 - protein, 18 aa, Plasmodium falciparum
IDMLLSLKEKFKPHIDGR

SEQ ID NO: 3403664 - protein, 25 aa, Plasmodium falciparum
IDPVLRSPCNFAFMPINISSSNGYL

SEQ ID NO: 3403665 - protein, 17 aa, Plasmodium falciparum
IDSFKGKGLHVSLRERI

SEQ ID NO: 3403666 - protein, 17 aa, Plasmodium falciparum
IEEYGSITFIHDILLDL

SEQ ID NO: 3403667 - protein, 24 aa, Plasmodium falciparum
IEIKKIDILFCVNNIPIFSHKGNY

SEQ ID NO: 3403668 - protein, 23 aa, Plasmodium falciparum
IEIYPCKAIKWERKKKKRDLIKN

SEQ ID NO: 3403669 - protein, 17 aa, Plasmodium falciparum
IEKCKRLNRAIRIGTNH

SEQ ID NO: 3403670 - protein, 24 aa, Plasmodium falciparum
IELRKDILQDISFECIRLNKIIQY

SEQ ID NO: 3403671 - protein, 17 aa, Plasmodium falciparum
IENMKIPINKALEKGGF

SEQ ID NO: 3403672 - protein, 20 aa, Plasmodium falciparum
IEPSFGIGRLIFCILEHSFR

SEQ ID NO: 3403673 - protein, 21 aa, Plasmodium falciparum
IERVLNLLSEVVIRRSSRFKL

SEQ ID NO: 3403674 - protein, 20 aa, Plasmodium falciparum
IEVEAMKMIMTFKSTESGIL

SEQ ID NO: 3403675 - protein, 21 aa, Plasmodium falciparum
IEYILTLWLFNTFKNKNVDIY

SEQ ID NO: 3403676 - protein, 18 aa, Plasmodium falciparum
IFFLFFFHLIKSYNINYH

SEQ ID NO: 3403677 - protein, 24 aa, Plasmodium falciparum
IFGEIFKIENDFAYVDINYSCYAE

SEQ ID NO: 3403678 - protein, 25 aa, Plasmodium falciparum
IFHHIFVTSCGIIFTNNDCYINDEK

SEQ ID NO: 3403679 - protein, 22 aa, Plasmodium falciparum
IFKEFMRYYIWKRYPSHQLRLY

SEQ ID NO: 3403680 - protein, 23 aa, Plasmodium falciparum
IFKNIKKRTKFIILNEPIVDLSF

SEQ ID NO: 3403681 - protein, 19 aa, Plasmodium falciparum
IFLFFIVLEILLLSDRNFI

SEQ ID NO: 3403682 - protein, 17 aa, Plasmodium falciparum
IFLYYVNAFKNTQKDGV

SEQ ID NO: 3403683 - protein, 20 aa, Plasmodium falciparum
IFMNECMYGFYYYDNINQYT

SEQ ID NO: 3403684 - protein, 18 aa, Plasmodium falciparum
IFNYYSGILIDLGVSSHQ

SEQ ID NO: 3403685 - protein, 17 aa, Plasmodium falciparum
IFRKKRCIKNLRTKEDI

SEQ ID NO: 3403686 - protein, 17 aa, Plasmodium falciparum
IFSHKKIYFNFKVSKNI

SEQ ID NO: 3403687 - protein, 20 aa, Plasmodium falciparum
IFSIYYIDGKSILRNNKSHN

SEQ ID NO: 3403688 - protein, 33 aa, Plasmodium falciparum
IFVILFHLIGYLKNENKCFCQFTDQPEGEHEDE

SEQ ID NO: 3403689 - protein, 20 aa, Plasmodium falciparum
IFVLFLDIYDCFKIKNFEYP

SEQ ID NO: 3403690 - protein, 17 aa, Plasmodium falciparum
IFWFIPYYCFNYVLCVG

SEQ ID NO: 3403691 - protein, 26 aa, Plasmodium falciparum
IFYKSEKRITTLLSELGKYSSENNSR

SEQ ID NO: 3403692 - protein, 18 aa, Plasmodium falciparum
IGLIYVWDITYSKKAKIF

SEQ ID NO: 3403693 - protein, 24 aa, Plasmodium falciparum
IGQFGVGFYSAFLVADKVIVYTKN

SEQ ID NO: 3403694 - protein, 19 aa, Plasmodium falciparum
IGRRFRLGFIDSQVSNKVI

SEQ ID NO: 3403695 - protein, 20 aa, Plasmodium falciparum
IGTSSLRRRSQIKNRYKNIY

SEQ ID NO: 3403696 - protein, 21 aa, Plasmodium falciparum
IHFNPKIALMAADVFEKIRVN

SEQ ID NO: 3403697 - protein, 17 aa, Plasmodium falciparum
IHFPNNKVNTFVSNKTN

SEQ ID NO: 3403698 - protein, 21 aa, Plasmodium falciparum
IHKEKFQLVHVIQKFLNDHYN

SEQ ID NO: 3403699 - protein, 19 aa, Plasmodium falciparum
IHNKIRSFINWPKAECTLF

SEQ ID NO: 3403700 - protein, 18 aa, Plasmodium falciparum
IHNNRHVCDFSKNNLIVP

SEQ ID NO: 3403701 - protein, 27 aa, Plasmodium falciparum
IHNYKVKCIFIGLPNVGKSALINRILE

SEQ ID NO: 3403702 - protein, 20 aa, Plasmodium falciparum
IHPLLYFNGIFIFDMMYQYI

SEQ ID NO: 3403703 - protein, 22 aa, Plasmodium falciparum
IIDEVLEDFIILRSNELPTYNF

SEQ ID NO: 3403704 - protein, 17 aa, Plasmodium falciparum
IIGSGNWGTVVSKIIGM

SEQ ID NO: 3403705 - protein, 23 aa, Plasmodium falciparum
IIHVYPCKSGCLGKDKGYSEICE

SEQ ID NO: 3403706 - protein, 31 aa, Plasmodium falciparum
IIIEVRNGIIPFVFDDLFALNIFDIHTNKPH

SEQ ID NO: 3403707 - protein, 23 aa, Plasmodium falciparum
IILGNCKIILSRPFKEEKKKKDI

SEQ ID NO: 3403708 - protein, 23 aa, Plasmodium falciparum
IILLCATIFKLLIYFMNEKGKVE

SEQ ID NO: 3403709 - protein, 18 aa, Plasmodium falciparum
IINNLFLHFFKKNKAHLL

SEQ ID NO: 3403710 - protein, 18 aa, Plasmodium falciparum
IIRRILVNYFKYDVFMVI

SEQ ID NO: 3403711 - protein, 18 aa, Plasmodium falciparum
IISDPGFVKSNHKKTEKN

SEQ ID NO: 3403712 - protein, 25 aa, Plasmodium falciparum
IISEFRFVLFKNFHLFLQENKINYI

SEQ ID NO: 3403713 - protein, 18 aa, Plasmodium falciparum
IISNIPLCKNYIENELKE

SEQ ID NO: 3403714 - protein, 22 aa, Plasmodium falciparum
IISRVANFLAQFLLFINLSDLT

SEQ ID NO: 3403715 - protein, 18 aa, Plasmodium falciparum
IIVLKKLINRLCYHIIEK

SEQ ID NO: 3403716 - protein, 17 aa, Plasmodium falciparum
IKCKGDEKLLRNCPHET

SEQ ID NO: 3403717 - protein, 18 aa, Plasmodium falciparum
IKCLPDNFCECECSCKNK

SEQ ID NO: 3403718 - protein, 26 aa, Plasmodium falciparum
IKDKFKELLCLNVNRSDPNRQYKLYK

SEQ ID NO: 3403719 - protein, 22 aa, Plasmodium falciparum
IKEHIIDKCVEQDIINRNISNE

SEQ ID NO: 3403720 - protein, 24 aa, Plasmodium falciparum
IKEKGFFKYIISYFRKNNRKYLND

SEQ ID NO: 3403721 - protein, 22 aa, Plasmodium falciparum
IKELNRRPLFILLKSDNIYEHV

SEQ ID NO: 3403722 - protein, 20 aa, Plasmodium falciparum
IKEPLAVRRKLLYSLLKSKD

SEQ ID NO: 3403723 - protein, 20 aa, Plasmodium falciparum
IKGVDLLYGEIVHFGTSKFI

SEQ ID NO: 3403724 - protein, 22 aa, Plasmodium falciparum
IKHFLKLVPRHNFLLDYHFNSI

SEQ ID NO: 3403725 - protein, 18 aa, Plasmodium falciparum
IKHPSSINIMNEIFCDNV

SEQ ID NO: 3403726 - protein, 18 aa, Plasmodium falciparum
IKIEKKCYLFWQCENNCV

SEQ ID NO: 3403727 - protein, 19 aa, Plasmodium falciparum
IKINSDILFQFKKQINHID

SEQ ID NO: 3403728 - protein, 19 aa, Plasmodium falciparum
IKKKFYLYIHPSKMPEAKP

SEQ ID NO: 3403729 - protein, 24 aa, Plasmodium falciparum
IKKKIKKKWIYSHEKEIKFYELIL

SEQ ID NO: 3403730 - protein, 21 aa, Plasmodium falciparum
IKKKILCCSNFVDEVENSLKY

SEQ ID NO: 3403731 - protein, 20 aa, Plasmodium falciparum
IKKLIEEGILDYEDLTENEL

SEQ ID NO: 3403732 - protein, 27 aa, Plasmodium falciparum
IKLDEHYDFYLGFDMEHIYEPKYKIDK

SEQ ID NO: 3403733 - protein, 18 aa, Plasmodium falciparum
IKLKHYIKETEEIHFNSI

SEQ ID NO: 3403734 - protein, 26 aa, Plasmodium falciparum
IKNLHFLKTVYLFDIFLNEQSKKTSY

SEQ ID NO: 3403735 - protein, 31 aa, Plasmodium falciparum
IKNMPSIYLSNWTRKTCNDIQLYIKYGKPND

SEQ ID NO: 3403736 - protein, 19 aa, Plasmodium falciparum
IKNSRKVYNLNLYNCDLID

SEQ ID NO: 3403737 - protein, 26 aa, Plasmodium falciparum
IKNVFLKKYFVFFLLYLINFNCDTLA

SEQ ID NO: 3403738 - protein, 17 aa, Plasmodium falciparum
IKQEVLNTLNFLFYVYN

SEQ ID NO: 3403739 - protein, 17 aa, Plasmodium falciparum
IKQYILRIPPYVHKDIH

SEQ ID NO: 3403740 - protein, 26 aa, Plasmodium falciparum
IKRECGEPFFSFYSYENILTVHNNKI

SEQ ID NO: 3403741 - protein, 26 aa, Plasmodium falciparum
IKRFQECDEIMDIKGRIIKPNTDLKH

SEQ ID NO: 3403742 - protein, 21 aa, Plasmodium falciparum
IKSKRKELQFLIRNSDEDNHQ

SEQ ID NO: 3403743 - protein, 17 aa, Plasmodium falciparum
IKTGTKYLAKILESKAF

SEQ ID NO: 3403744 - protein, 18 aa, Plasmodium falciparum
IKYAHEIIDSMKLTDKVK

SEQ ID NO: 3403745 - protein, 20 aa, Plasmodium falciparum
IKYRNIHYIHMPNNAHNKNF

SEQ ID NO: 3403746 - protein, 30 aa, Plasmodium falciparum
ILAEFKGKIFRNIIVLSRHILFLLEGLELI

SEQ ID NO: 3403747 - protein, 25 aa, Plasmodium falciparum
ILASFLKTFICYSPKNVITVSPPRN

SEQ ID NO: 3403748 - protein, 31 aa, Plasmodium falciparum
ILDIGSACLKIGQVVPVKILGAFTLIDEGEL

SEQ ID NO: 3403749 - protein, 18 aa, Plasmodium falciparum
ILDIYKLRNSIKTQIATY

SEQ ID NO: 3403750 - protein, 23 aa, Plasmodium falciparum
ILEEKLRYYSCITRNSTISIKHD

SEQ ID NO: 3403751 - protein, 18 aa, Plasmodium falciparum
ILEELKYPDRINGVKSKT

SEQ ID NO: 3403752 - protein, 17 aa, Plasmodium falciparum
ILEPMPVRPVYEVKNNN

SEQ ID NO: 3403753 - protein, 18 aa, Plasmodium falciparum
ILFDRNYPGYAYTNHGEN

SEQ ID NO: 3403754 - protein, 28 aa, Plasmodium falciparum
ILHKLMPKFFYTRLLHIYKYLKRNEDLV

SEQ ID NO: 3403755 - protein, 23 aa, Plasmodium falciparum
ILIKKLLGRRICNICDKNFNVSN

SEQ ID NO: 3403756 - protein, 19 aa, Plasmodium falciparum
ILKDIKIKAGIYGDLSVEY

SEQ ID NO: 3403757 - protein, 20 aa, Plasmodium falciparum
ILKEHIEYIYEKRNGTKVNL

SEQ ID NO: 3403758 - protein, 17 aa, Plasmodium falciparum
ILKEPVLSKVLYNEILF

SEQ ID NO: 3403759 - protein, 17 aa, Plasmodium falciparum
ILLGFGISSSSGRINSA

SEQ ID NO: 3403760 - protein, 27 aa, Plasmodium falciparum
ILLNLYKCASISCEIDYTPSTNITSNL

SEQ ID NO: 3403761 - protein, 17 aa, Plasmodium falciparum
ILNALKYEHHVNDPLNT

SEQ ID NO: 3403762 - protein, 17 aa, Plasmodium falciparum
ILNECRNNFATKLRQDP

SEQ ID NO: 3403763 - protein, 25 aa, Plasmodium falciparum
ILNKHLIEIIPFNNIINSLDYIFLF

SEQ ID NO: 3403764 - protein, 20 aa, Plasmodium falciparum
ILNKIPNCRIIGIDKDIEAL

SEQ ID NO: 3403765 - protein, 18 aa, Plasmodium falciparum
ILQYSLHNHMLFKYLHNI

SEQ ID NO: 3403766 - protein, 18 aa, Plasmodium falciparum
ILSAAVFASVLLLDNNNS

SEQ ID NO: 3403767 - protein, 21 aa, Plasmodium falciparum
ILSAQEFEYFKKRGINENISE

SEQ ID NO: 3403768 - protein, 18 aa, Plasmodium falciparum
ILSDNFCRWKKLPNEEKM

SEQ ID NO: 3403769 - protein, 20 aa, Plasmodium falciparum
ILSRVGDFYETYGLDSIFLI

SEQ ID NO: 3403770 - protein, 18 aa, Plasmodium falciparum
ILYHFIKQYIPLVEPSDE

SEQ ID NO: 3403771 - protein, 24 aa, Plasmodium falciparum
ILYHINISPYLYKLFELTHIDKKC

SEQ ID NO: 3403772 - protein, 18 aa, Plasmodium falciparum
ILYLQHDLITIKWKVYEE

SEQ ID NO: 3403773 - protein, 25 aa, Plasmodium falciparum
INENIFPDYFFLDIFTENKEQKNEE

SEQ ID NO: 3403774 - protein, 17 aa, Plasmodium falciparum
INGILMEKSNLWTLDIS

SEQ ID NO: 3403775 - protein, 17 aa, Plasmodium falciparum
INIFKKPIYIISTTEYY

SEQ ID NO: 3403776 - protein, 19 aa, Plasmodium falciparum
INKRLKYINSKIISRRKEN

SEQ ID NO: 3403777 - protein, 23 aa, Plasmodium falciparum
INLCRIKYNKPVIVATQMMESMR

SEQ ID NO: 3403778 - protein, 21 aa, Plasmodium falciparum
INNWWLYLTKQILCLHKGELR

SEQ ID NO: 3403779 - protein, 17 aa, Plasmodium falciparum
INYIITYIFNLIKNKVN

SEQ ID NO: 3403780 - protein, 19 aa, Plasmodium falciparum
IPATILLLRHHKIINGYIN

SEQ ID NO: 3403781 - protein, 24 aa, Plasmodium falciparum
IPCLIKSSYGYNIYFKRGLTHISK

SEQ ID NO: 3403782 - protein, 23 aa, Plasmodium falciparum
IPDRLSLPVDMEFLHTSDTLNIL

SEQ ID NO: 3403783 - protein, 26 aa, Plasmodium falciparum
IPISAELRGGSWVVVDETLNSQIIEM

SEQ ID NO: 3403784 - protein, 22 aa, Plasmodium falciparum
IPKDELLFFLKHAYVNIYNSLK

SEQ ID NO: 3403785 - protein, 25 aa, Plasmodium falciparum
IPKDMNIEYAINYLFIYTPFIVYPS

SEQ ID NO: 3403786 - protein, 23 aa, Plasmodium falciparum
IPKYCIGSTYFLRQVSIEDIAGN

SEQ ID NO: 3403787 - protein, 17 aa, Plasmodium falciparum
IPSKNCFTRACYNKRKY

SEQ ID NO: 3403788 - protein, 28 aa, Plasmodium falciparum
IPSLNKYLYGLRMGELSIWTGSTGVGKT

SEQ ID NO: 3403789 - protein, 20 aa, Plasmodium falciparum
IPYYCFNYVLCVGNKNDMLF

SEQ ID NO: 3403790 - protein, 18 aa, Plasmodium falciparum
IQKKARIAKDILFQHLKL

SEQ ID NO: 3403791 - protein, 28 aa, Plasmodium falciparum
IQNKCNCCFYSIPLIHIYHPNGSMHCLS

SEQ ID NO: 3403792 - protein, 19 aa, Plasmodium falciparum
IQRGIQLASKMIIEKIKSL

SEQ ID NO: 3403793 - protein, 32 aa, Plasmodium falciparum
IQYSTFFLFWNFSTEFWKRFQYIHNNDIHNIN

SEQ ID NO: 3403794 - protein, 20 aa, Plasmodium falciparum
IRIRCVYFCDRIYKNEELKD

SEQ ID NO: 3403795 - protein, 18 aa, Plasmodium falciparum
IRKNRNVSIAMIFVDNKN

SEQ ID NO: 3403796 - protein, 21 aa, Plasmodium falciparum
IRNKEIYRYNGVNNIRGLLLW

SEQ ID NO: 3403797 - protein, 19 aa, Plasmodium falciparum
IRRHKGVELSRKMVAENIQ

SEQ ID NO: 3403798 - protein, 21 aa, Plasmodium falciparum
IRRSSRFKLLKTDTEKQNQQD

SEQ ID NO: 3403799 - protein, 20 aa, Plasmodium falciparum
IRYSDFFKVLYNLILSFFKI

SEQ ID NO: 3403800 - protein, 28 aa, Plasmodium falciparum
ISESLEFFKNIFLFYPPFEVTKHIRYIN

SEQ ID NO: 3403801 - protein, 19 aa, Plasmodium falciparum
ISGCGPAYVYLFIESLIDA

SEQ ID NO: 3403802 - protein, 17 aa, Plasmodium falciparum
ISKAFLIHKKEGGGKAF

SEQ ID NO: 3403803 - protein, 28 aa, Plasmodium falciparum
ISLICLFFGCSNKLYALRNVTRKSEPMS

SEQ ID NO: 3403804 - protein, 19 aa, Plasmodium falciparum
ISLIPKTVIGIKCPNKKLN

SEQ ID NO: 3403805 - protein, 25 aa, Plasmodium falciparum
ISNFIHRFGDKFKFFNTPEKIQRED

SEQ ID NO: 3403806 - protein, 27 aa, Plasmodium falciparum
ISNLPPFKRWLVKRIISMRKANNNGSF

SEQ ID NO: 3403807 - protein, 18 aa, Plasmodium falciparum
ISNNISHIYMIRKNVTFF

SEQ ID NO: 3403808 - protein, 20 aa, Plasmodium falciparum
ISSCLPIFHHIFVTSCGIIF

SEQ ID NO: 3403809 - protein, 21 aa, Plasmodium falciparum
ISSCNKYYVNYGILMNLTKKG

SEQ ID NO: 3403810 - protein, 31 aa, Plasmodium falciparum
ISSKELAQRMAIMFTKWLAPDEYGAVVDYEN

SEQ ID NO: 3403811 - protein, 19 aa, Plasmodium falciparum
ISVDKYLLFRCLRDDNMLN

SEQ ID NO: 3403812 - protein, 17 aa, Plasmodium falciparum
ISVNCGGYDDFREIPGI

SEQ ID NO: 3403813 - protein, 21 aa, Plasmodium falciparum
ITCIYKNNFLQLKMKLSHRKY

SEQ ID NO: 3403814 - protein, 33 aa, Plasmodium falciparum
ITDWKLRGSCSYDNYICGALNYMNNIYSKGDRV

SEQ ID NO: 3403815 - protein, 18 aa, Plasmodium falciparum
ITIFSIYLINGAIKNESY

SEQ ID NO: 3403816 - protein, 18 aa, Plasmodium falciparum
ITINAAVTTCYWNGSEKN

SEQ ID NO: 3403817 - protein, 18 aa, Plasmodium falciparum
ITKLLYFERPFPSKEKYY

SEQ ID NO: 3403818 - protein, 27 aa, Plasmodium falciparum
ITLPIIMNKYFSFRISILDDKRCRRTF

SEQ ID NO: 3403819 - protein, 24 aa, Plasmodium falciparum
ITNILKALFCYNTNNLIIVNKEKK

SEQ ID NO: 3403820 - protein, 22 aa, Plasmodium falciparum
ITNKDIINFLLIKSNHINITKL

SEQ ID NO: 3403821 - protein, 18 aa, Plasmodium falciparum
ITNSISFANKFRTYDEES

SEQ ID NO: 3403822 - protein, 19 aa, Plasmodium falciparum
ITTYQEWKKAGILPSDDKE

SEQ ID NO: 3403823 - protein, 25 aa, Plasmodium falciparum
IVHIFRDFNFLFFLTNIFSIKHDLP

SEQ ID NO: 3403824 - protein, 18 aa, Plasmodium falciparum
IVHLKIGNRYAYTHYHKQ

SEQ ID NO: 3403825 - protein, 17 aa, Plasmodium falciparum
IVNLKYEGIINIKNHLI

SEQ ID NO: 3403826 - protein, 19 aa, Plasmodium falciparum
IVSNSGFLPTEFDYPYFYA

SEQ ID NO: 3403827 - protein, 23 aa, Plasmodium falciparum
IVYCFISSFYLIKSSSNDKNKIN

SEQ ID NO: 3403828 - protein, 25 aa, Plasmodium falciparum
IVYLPSLKNMVAWAGYADINKAVNL

SEQ ID NO: 3403829 - protein, 19 aa, Plasmodium falciparum
IYAVGCAMGDVVITDLLFN

SEQ ID NO: 3403830 - protein, 23 aa, Plasmodium falciparum
IYEVHAFDFKLLHYIFSRNQLLN

SEQ ID NO: 3403831 - protein, 25 aa, Plasmodium falciparum
IYFFKRLEEAMSIKIGLKNARHKYF

SEQ ID NO: 3403832 - protein, 18 aa, Plasmodium falciparum
IYICEANGTLSENIESAE

SEQ ID NO: 3403833 - protein, 19 aa, Plasmodium falciparum
IYIIRLTKYKDMNFLCSLK

SEQ ID NO: 3403834 - protein, 20 aa, Plasmodium falciparum
IYKCEHENFINPRVNKTFDE

SEQ ID NO: 3403835 - protein, 31 aa, Plasmodium falciparum
IYKEFYENIMFSIEFKSFIPLIKDELDKLSR

SEQ ID NO: 3403836 - protein, 22 aa, Plasmodium falciparum
IYKKEHLFNFSNFVEIKEKGFF

SEQ ID NO: 3403837 - protein, 23 aa, Plasmodium falciparum
IYKLQKAIIDWKYPATKYSISLS

SEQ ID NO: 3403838 - protein, 21 aa, Plasmodium falciparum
IYKREKLLYVRIINKTLDRNV

SEQ ID NO: 3403839 - protein, 24 aa, Plasmodium falciparum
IYMIKRYYTAYALEGVCSYLEHDK

SEQ ID NO: 3403840 - protein, 23 aa, Plasmodium falciparum
IYNSELFCLLTVHEKFSYDYTNN

SEQ ID NO: 3403841 - protein, 22 aa, Plasmodium falciparum
IYSFGNTCVIDYENICETTDYN

SEQ ID NO: 3403842 - protein, 20 aa, Plasmodium falciparum
IYSIFKFLTIDIRFLFYPSC

SEQ ID NO: 3403843 - protein, 18 aa, Plasmodium falciparum
IYTIRGRQWEMVLDNLLV

SEQ ID NO: 3403844 - protein, 19 aa, Plasmodium falciparum
IYYYYKIKLLQLLNQTANE

SEQ ID NO: 3403845 - protein, 24 aa, Plasmodium falciparum
KAFLEKKKALELLNDTKDIKENYN

SEQ ID NO: 3403846 - protein, 17 aa, Plasmodium falciparum
KAKEFGISIIEFDNMTK

SEQ ID NO: 3403847 - protein, 24 aa, Plasmodium falciparum
KAKKNFIFLPTWVMKSLNLNCFDV

SEQ ID NO: 3403848 - protein, 18 aa, Plasmodium falciparum
KALKIAKKIIQWRKENGM

SEQ ID NO: 3403849 - protein, 23 aa, Plasmodium falciparum
KASPEFYHNLYFKNFNVGKKNLF

SEQ ID NO: 3403850 - protein, 36 aa, Plasmodium falciparum
KASSFLKIACSHVMKLIEFIPESKLSSQYIKVDNKN

SEQ ID NO: 3403851 - protein, 19 aa, Plasmodium falciparum
KAYTYYLLLCELIKNKEKQ

SEQ ID NO: 3403852 - protein, 21 aa, Plasmodium falciparum
KCGIIWKCKSITYTTNFDDIC

SEQ ID NO: 3403853 - protein, 22 aa, Plasmodium falciparum
KCIEEASKLFGEDISKWDEKMY

SEQ ID NO: 3403854 - protein, 19 aa, Plasmodium falciparum
KCILSLKDWLFKKFYDENL

SEQ ID NO: 3403855 - protein, 18 aa, Plasmodium falciparum
KCKEALKHYEEWVNRRRP

SEQ ID NO: 3403856 - protein, 22 aa, Plasmodium falciparum
KCLKDYTLPCPNYWKRRTDKYG

SEQ ID NO: 3403857 - protein, 20 aa, Plasmodium falciparum
KCPFRWTYIDNNLCIAPEDY

SEQ ID NO: 3403858 - protein, 22 aa, Plasmodium falciparum
KCPNDYSILLGFGISSSSGRIN

SEQ ID NO: 3403859 - protein, 25 aa, Plasmodium falciparum
KCSNRYKLKCPVGNGSSDMFSGQSI

SEQ ID NO: 3403860 - protein, 17 aa, Plasmodium falciparum
KCTVKIKKGDIFGLKCP

SEQ ID NO: 3403861 - protein, 37 aa, Plasmodium falciparum
KDEKYKSFCFYFIRLVDSISGLFCTIAKRKKREEILN

SEQ ID NO: 3403862 - protein, 25 aa, Plasmodium falciparum
KDELMKRIVQDVSYDINNFINDQYE

SEQ ID NO: 3403863 - protein, 18 aa, Plasmodium falciparum
KDEMCVQEHNTLPYSNEN

SEQ ID NO: 3403864 - protein, 19 aa, Plasmodium falciparum
KDIEALELIGSGWRVPKIL

SEQ ID NO: 3403865 - protein, 28 aa, Plasmodium falciparum
KDIEIKDVKRVPCFDPNLADITIEQTKN

SEQ ID NO: 3403866 - protein, 21 aa, Plasmodium falciparum
KDIIKKVAHSRVFNNHKNNNK

SEQ ID NO: 3403867 - protein, 18 aa, Plasmodium falciparum
KDIILRSTPYNNIILDEK

SEQ ID NO: 3403868 - protein, 19 aa, Plasmodium falciparum
KDILPKLGKYELHELGPNN

SEQ ID NO: 3403869 - protein, 22 aa, Plasmodium falciparum
KDKGYMRLYPKNVRNEMKLFFF

SEQ ID NO: 3403870 - protein, 21 aa, Plasmodium falciparum
KDKLETMLKGAGVNVDKIKDS

SEQ ID NO: 3403871 - protein, 18 aa, Plasmodium falciparum
KDKNCPKLTHGIKKMSYE

SEQ ID NO: 3403872 - protein, 17 aa, Plasmodium falciparum
KDLPYLKNVIILDTLIK

SEQ ID NO: 3403873 - protein, 30 aa, Plasmodium falciparum
KDMDEIKHLFPVIGEKLLNMNGQDGNINIK

SEQ ID NO: 3403874 - protein, 18 aa, Plasmodium falciparum
KDYLKAFYTYALASYEGY

SEQ ID NO: 3403875 - protein, 17 aa, Plasmodium falciparum
KEDIIDGIEKCWFNITD

SEQ ID NO: 3403876 - protein, 26 aa, Plasmodium falciparum
KEDNYHLYYWDDFYHEYKPTYLNYHM

SEQ ID NO: 3403877 - protein, 23 aa, Plasmodium falciparum
KEDSEFYYSLDFQTNVHDIIAKF

SEQ ID NO: 3403878 - protein, 19 aa, Plasmodium falciparum
KEENSEVMSLYKTGQHKPK

SEQ ID NO: 3403879 - protein, 18 aa, Plasmodium falciparum
KEFFEIMENIKSNKFIKK

SEQ ID NO: 3403880 - protein, 20 aa, Plasmodium falciparum
KEFKDNVTLLKAVIDNKKNQ

SEQ ID NO: 3403881 - protein, 18 aa, Plasmodium falciparum
KEHVRLAAQELRKKTHFV

SEQ ID NO: 3403882 - protein, 26 aa, Plasmodium falciparum
KEINFNSLCPMGWNIVDIKNHICQIP

SEQ ID NO: 3403883 - protein, 22 aa, Plasmodium falciparum
KEIPYYLDHGVEWRNFNHDELI

SEQ ID NO: 3403884 - protein, 23 aa, Plasmodium falciparum
KEISKPTGNLRFKEKESINKVNT

SEQ ID NO: 3403885 - protein, 18 aa, Plasmodium falciparum
KEKCDLINIIIKSFHEDT

SEQ ID NO: 3403886 - protein, 31 aa, Plasmodium falciparum
KEKHIKCIKNFCKECCLYHTQLLDSNEKNEC

SEQ ID NO: 3403887 - protein, 17 aa, Plasmodium falciparum
KEKKINVAFYLEYTSED

SEQ ID NO: 3403888 - protein, 25 aa, Plasmodium falciparum
KEKWSIKCETFWPCKRCVRNYTSFC

SEQ ID NO: 3403889 - protein, 21 aa, Plasmodium falciparum
KELKEKWIQIGQWYKEPLSPS

SEQ ID NO: 3403890 - protein, 20 aa, Plasmodium falciparum
KELLKTIFIQHMEKSQTTTF

SEQ ID NO: 3403891 - protein, 25 aa, Plasmodium falciparum
KELLPYYLQVCHKYADLHDMSTCMK

SEQ ID NO: 3403892 - protein, 21 aa, Plasmodium falciparum
KELQKRPSLVYSQKNFNLEKI

SEQ ID NO: 3403893 - protein, 18 aa, Plasmodium falciparum
KELVWVCATYEQYNEIKE

SEQ ID NO: 3403894 - protein, 19 aa, Plasmodium falciparum
KENEALFLQNFPKKTLFLY

SEQ ID NO: 3403895 - protein, 24 aa, Plasmodium falciparum
KENFFFKNFHVFANIGERKRSSLL

SEQ ID NO: 3403896 - protein, 22 aa, Plasmodium falciparum
KENNFIGGFGFIGEQIPIAVGL

SEQ ID NO: 3403897 - protein, 24 aa, Plasmodium falciparum
KEQFSSTCKVVWPCKEESCERDYS

SEQ ID NO: 3403898 - protein, 18 aa, Plasmodium falciparum
KEQWKLYYMETFDVKNES

SEQ ID NO: 3403899 - protein, 19 aa, Plasmodium falciparum
KERIYICYTKELYSYYEQD

SEQ ID NO: 3403900 - protein, 24 aa, Plasmodium falciparum
KETLEMKRFLLVHGGEPVNYKKSD

SEQ ID NO: 3403901 - protein, 30 aa, Plasmodium falciparum
KEVVKDIQGVWKFFLPVYIMDREFKRAKDM

SEQ ID NO: 3403902 - protein, 21 aa, Plasmodium falciparum
KEWCYVEVQLIGKGNRDWDYC

SEQ ID NO: 3403903 - protein, 19 aa, Plasmodium falciparum
KEYIEPFLVMLSIVSNIYN

SEQ ID NO: 3403904 - protein, 20 aa, Plasmodium falciparum
KEYRNKLLALRKRTFNTKNT

SEQ ID NO: 3403905 - protein, 19 aa, Plasmodium falciparum
KFDAKFLLHNNFKIENIFD

SEQ ID NO: 3403906 - protein, 23 aa, Plasmodium falciparum
KFGDLYIKFLIQFPKQLTDEQKK

SEQ ID NO: 3403907 - protein, 21 aa, Plasmodium falciparum
KFIIDLCSDHSFIFEKRLNEE

SEQ ID NO: 3403908 - protein, 24 aa, Plasmodium falciparum
KFIIYIRCLLEWLPQINPHLNPFV

SEQ ID NO: 3403909 - protein, 25 aa, Plasmodium falciparum
KFKYFTLEITKFVLRHILKKLPFNY

SEQ ID NO: 3403910 - protein, 20 aa, Plasmodium falciparum
KFPTNCIPFSTIDYNNKKGK

SEQ ID NO: 3403911 - protein, 19 aa, Plasmodium falciparum
KFQRVKLEFGYDNMNTSEI

SEQ ID NO: 3403912 - protein, 17 aa, Plasmodium falciparum
KFRINVYCIVYIAIPKE

SEQ ID NO: 3403913 - protein, 24 aa, Plasmodium falciparum
KGDIFGLKCPKGFAIFPQACFSNV

SEQ ID NO: 3403914 - protein, 18 aa, Plasmodium falciparum
KGIILGNFIKMYDGTKNN

SEQ ID NO: 3403915 - protein, 19 aa, Plasmodium falciparum
KGKLRYYHNSIYWNYGALP

SEQ ID NO: 3403916 - protein, 17 aa, Plasmodium falciparum
KGSHFHIYSVVDNNVNL

SEQ ID NO: 3403917 - protein, 21 aa, Plasmodium falciparum
KGVHAKEYICQYISYEKEPPC

SEQ ID NO: 3403918 - protein, 18 aa, Plasmodium falciparum
KHIYSLDIYKDIYTRDPS

SEQ ID NO: 3403919 - protein, 27 aa, Plasmodium falciparum
KHLLRRWKYDLFEKIKEKMKYEDETKR

SEQ ID NO: 3403920 - protein, 19 aa, Plasmodium falciparum
KHNLIKYDFFLKKKNFILL

SEQ ID NO: 3403921 - protein, 19 aa, Plasmodium falciparum
KHSEGLLKRFQIVDKDKDG

SEQ ID NO: 3403922 - protein, 25 aa, Plasmodium falciparum
KHTKKRICKECCIKIDLYTKLLSRP

SEQ ID NO: 3403923 - protein, 22 aa, Plasmodium falciparum
KHVFYNTCHIILLCATIFKLLI

SEQ ID NO: 3403924 - protein, 25 aa, Plasmodium falciparum
KIADICILVIDGSYGIELETLEFLN

SEQ ID NO: 3403925 - protein, 23 aa, Plasmodium falciparum
KIDEIKEKLGLQFQLNKDSQDLM

SEQ ID NO: 3403926 - protein, 17 aa, Plasmodium falciparum
KIELTCFDKMLSKSNLS

SEQ ID NO: 3403927 - protein, 18 aa, Plasmodium falciparum
KIENYYLFNNFKSSFYFH

SEQ ID NO: 3403928 - protein, 23 aa, Plasmodium falciparum
KIIELIRIFFPVNVLNYYPISNK

SEQ ID NO: 3403929 - protein, 30 aa, Plasmodium falciparum
KIIVDETFIKLCILHKISIKEELVKLMNRQ

SEQ ID NO: 3403930 - protein, 17 aa, Plasmodium falciparum
KIKDCSKGSISCFLSNI

SEQ ID NO: 3403931 - protein, 17 aa, Plasmodium falciparum
KIKLRIHFFDLWEDDSL

SEQ ID NO: 3403932 - protein, 21 aa, Plasmodium falciparum
KILFNEKSFFCVPYNSSENFE

SEQ ID NO: 3403933 - protein, 18 aa, Plasmodium falciparum
KILQRINNFFTEIIKNIP

SEQ ID NO: 3403934 - protein, 17 aa, Plasmodium falciparum
KIMKIVIPQTSGLNIVD

SEQ ID NO: 3403935 - protein, 17 aa, Plasmodium falciparum
KINTLKCNEEESVTSET

SEQ ID NO: 3403936 - protein, 19 aa, Plasmodium falciparum
KIQKSICKINAKALDVVTI

SEQ ID NO: 3403937 - protein, 20 aa, Plasmodium falciparum
KIQQGCCKYYKAVRKGYERK

SEQ ID NO: 3403938 - protein, 18 aa, Plasmodium falciparum
KIRLTLPKQFSWGDPFND

SEQ ID NO: 3403939 - protein, 19 aa, Plasmodium falciparum
KIRMSDIVILKLYVNVKIK

SEQ ID NO: 3403940 - protein, 24 aa, Plasmodium falciparum
KIRMYKSRLNPFSTINSNLYFGSS

SEQ ID NO: 3403941 - protein, 19 aa, Plasmodium falciparum
KISMFKINLQNDFNYENKR

SEQ ID NO: 3403942 - protein, 18 aa, Plasmodium falciparum
KIVGVSCRIKEKINPNLE

SEQ ID NO: 3403943 - protein, 19 aa, Plasmodium falciparum
KKADKGLCLIYLKEGEKLE

SEQ ID NO: 3403944 - protein, 19 aa, Plasmodium falciparum
KKDGVCLIQNPCLKDNGGC

SEQ ID NO: 3403945 - protein, 22 aa, Plasmodium falciparum
KKDIKNVSNWSAYIINNINDIL

SEQ ID NO: 3403946 - protein, 24 aa, Plasmodium falciparum
KKDLRHLMHIINVFIKEISKLFDH

SEQ ID NO: 3403947 - protein, 17 aa, Plasmodium falciparum
KKENVFYDFQWGKDFSF

SEQ ID NO: 3403948 - protein, 25 aa, Plasmodium falciparum
KKETWEYIVHLPFINCNMINKIITE

SEQ ID NO: 3403949 - protein, 19 aa, Plasmodium falciparum
KKFRFSNLQKIYGSTQTHL

SEQ ID NO: 3403950 - protein, 17 aa, Plasmodium falciparum
KKGEGISFFIPPIKQDT

SEQ ID NO: 3403951 - protein, 21 aa, Plasmodium falciparum
KKGKECYVLISSTYILKNKSK

SEQ ID NO: 3403952 - protein, 17 aa, Plasmodium falciparum
KKGLPSVIEIFYLSGKI

SEQ ID NO: 3403953 - protein, 20 aa, Plasmodium falciparum
KKGYRFSLKNSSFCLNQSYS

SEQ ID NO: 3403954 - protein, 17 aa, Plasmodium falciparum
KKGYRSKLDPNLRVNNI

SEQ ID NO: 3403955 - protein, 18 aa, Plasmodium falciparum
KKHSCTRSYAFNPENYEK

SEQ ID NO: 3403956 - protein, 24 aa, Plasmodium falciparum
KKILPHRYPFLLVDKVIYMQPNKT

SEQ ID NO: 3403957 - protein, 17 aa, Plasmodium falciparum
KKINVAFYLEYTSEDND

SEQ ID NO: 3403958 - protein, 18 aa, Plasmodium falciparum
KKITDFKIEDEVNGTVKF

SEQ ID NO: 3403959 - protein, 19 aa, Plasmodium falciparum
KKIYFNFKVSKNITKNSSS

SEQ ID NO: 3403960 - protein, 19 aa, Plasmodium falciparum
KKKELTVIVSRMKTDMLSL

SEQ ID NO: 3403961 - protein, 18 aa, Plasmodium falciparum
KKKIWNRLLLSKEKYPNM

SEQ ID NO: 3403962 - protein, 20 aa, Plasmodium falciparum
KKKKKVLGFKTKEPQANLEN

SEQ ID NO: 3403963 - protein, 20 aa, Plasmodium falciparum
KKKKNAYDFALWKSSKPNEP

SEQ ID NO: 3403964 - protein, 19 aa, Plasmodium falciparum
KKKKSCYVYNIQNNNINNN

SEQ ID NO: 3403965 - protein, 20 aa, Plasmodium falciparum
KKKNDMKVLGIDTIGTLYVL

SEQ ID NO: 3403966 - protein, 18 aa, Plasmodium falciparum
KKKNEKLAKRRRRRERNR

SEQ ID NO: 3403967 - protein, 25 aa, Plasmodium falciparum
KKKNRWSTIGFSRKKINNFDYIDDI

SEQ ID NO: 3403968 - protein, 23 aa, Plasmodium falciparum
KKKYEINDYLAVGIGLDRIAMIK

SEQ ID NO: 3403969 - protein, 25 aa, Plasmodium falciparum
KKKYKNVLLIFFLYIIFFVSKSYSG

SEQ ID NO: 3403970 - protein, 19 aa, Plasmodium falciparum
KKKYMTCFPSVSENDEVDI

SEQ ID NO: 3403971 - protein, 27 aa, Plasmodium falciparum
KKLHIKECCLIGFSLGGKASMYCALKN

SEQ ID NO: 3403972 - protein, 24 aa, Plasmodium falciparum
KKMDSLCLFQSCITTIGKYMYVPP

SEQ ID NO: 3403973 - protein, 20 aa, Plasmodium falciparum
KKNHVICSIIDFRNLNSDLQ

SEQ ID NO: 3403974 - protein, 22 aa, Plasmodium falciparum
KKNIKDFFSFSIKLGKDKNINL

SEQ ID NO: 3403975 - protein, 20 aa, Plasmodium falciparum
KKNKELKNEIQIFRDNLYTP

SEQ ID NO: 3403976 - protein, 25 aa, Plasmodium falciparum
KKNYRLCTLNDLYNGGAIHYARING

SEQ ID NO: 3403977 - protein, 21 aa, Plasmodium falciparum
KKPFSIILFDEIEKAHSEVLH

SEQ ID NO: 3403978 - protein, 20 aa, Plasmodium falciparum
KKRCIKNLRTKEDIEIESSH

SEQ ID NO: 3403979 - protein, 19 aa, Plasmodium falciparum
KKRGCYSFMNEDNYYYDKL

SEQ ID NO: 3403980 - protein, 19 aa, Plasmodium falciparum
KKRIKKRKNINLIIDKNVI

SEQ ID NO: 3403981 - protein, 21 aa, Plasmodium falciparum
KKRYLSQIVTPEFPIYLNNIQ

SEQ ID NO: 3403982 - protein, 31 aa, Plasmodium falciparum
KKSAEGMKCKTCKKLLKPRVKFCVYCGTNVS

SEQ ID NO: 3403983 - protein, 22 aa, Plasmodium falciparum
KKSNMCLDIKPMLYTENDKNIS

SEQ ID NO: 3403984 - protein, 18 aa, Plasmodium falciparum
KKTSVYRCGNFIDLCLGP

SEQ ID NO: 3403985 - protein, 28 aa, Plasmodium falciparum
KKVIIKSINCLIKWNISSENEYKKNNDE

SEQ ID NO: 3403986 - protein, 20 aa, Plasmodium falciparum
KKVNNLMLYEFLEKEANHIF

SEQ ID NO: 3403987 - protein, 30 aa, Plasmodium falciparum
KKVSETPAMELRLSKKHSLLKKRENLEMLH

SEQ ID NO: 3403988 - protein, 19 aa, Plasmodium falciparum
KKYENRRYKFPKNRKGNNN

SEQ ID NO: 3403989 - protein, 17 aa, Plasmodium falciparum
KKYIYNRKCRDMNNEQI

SEQ ID NO: 3403990 - protein, 20 aa, Plasmodium falciparum
KKYLEIIKKILDLEEDVLNK

SEQ ID NO: 3403991 - protein, 24 aa, Plasmodium falciparum
KKYNIFRKHYDNFVINQKEYDIIK

SEQ ID NO: 3403992 - protein, 18 aa, Plasmodium falciparum
KLESCKKIIAEIILDKNK

SEQ ID NO: 3403993 - protein, 19 aa, Plasmodium falciparum
KLFLFSILSFVVFLFILNY

SEQ ID NO: 3403994 - protein, 28 aa, Plasmodium falciparum
KLGRLGDMFKCLDYCISRNAHMINGSFS

SEQ ID NO: 3403995 - protein, 24 aa, Plasmodium falciparum
KLHLLKPQVWRLLKPNDEMNTKHL

SEQ ID NO: 3403996 - protein, 24 aa, Plasmodium falciparum
KLHQAGICHLDFTLDNILISKNGD

SEQ ID NO: 3403997 - protein, 24 aa, Plasmodium falciparum
KLIKEFNIKIIIAITKVDIPNVDV

SEQ ID NO: 3403998 - protein, 19 aa, Plasmodium falciparum
KLIKYKIILKYGNKDNKKE

SEQ ID NO: 3403999 - protein, 18 aa, Plasmodium falciparum
KLINRLCYHIIEKKKKKG

SEQ ID NO: 3404000 - protein, 21 aa, Plasmodium falciparum
KLIQAPCVFFPDNSFKTAQSI

SEQ ID NO: 3404001 - protein, 19 aa, Plasmodium falciparum
KLKADIYWESTVVGGNREK

SEQ ID NO: 3404002 - protein, 20 aa, Plasmodium falciparum
KLKGAIKVVPIRAPSFGDRR

SEQ ID NO: 3404003 - protein, 18 aa, Plasmodium falciparum
KLKHLEYINIPFSRSIFK

SEQ ID NO: 3404004 - protein, 27 aa, Plasmodium falciparum
KLKNESICVLSFLYLIGINDDNGKLHF

SEQ ID NO: 3404005 - protein, 18 aa, Plasmodium falciparum
KLKNSVAHIQCLLSYGFS

SEQ ID NO: 3404006 - protein, 19 aa, Plasmodium falciparum
KLKSNELKVLGIINKYSPK

SEQ ID NO: 3404007 - protein, 21 aa, Plasmodium falciparum
KLKVILCTGDDYKNCDNPSSS

SEQ ID NO: 3404008 - protein, 18 aa, Plasmodium falciparum
KLLKEINHTKVFKEMDNT

SEQ ID NO: 3404009 - protein, 29 aa, Plasmodium falciparum
KLLRSNDPLIFSVGWRRYQSIPIYSISER

SEQ ID NO: 3404010 - protein, 17 aa, Plasmodium falciparum
KLMLNLFSSENFLYYIN

SEQ ID NO: 3404011 - protein, 26 aa, Plasmodium falciparum
KLMMKPGSFLPVKIFLFAFSEYNYIN

SEQ ID NO: 3404012 - protein, 25 aa, Plasmodium falciparum
KLNECRHIVPLKAQKLIPGLTKIFE

SEQ ID NO: 3404013 - protein, 30 aa, Plasmodium falciparum
KLNFFTSLYLEYFSFLALDMHANIQTKIQL

SEQ ID NO: 3404014 - protein, 19 aa, Plasmodium falciparum
KLRNPALCFKNIEEWLVNK

SEQ ID NO: 3404015 - protein, 26 aa, Plasmodium falciparum
KLSDFLKCYKKYLALSIFGYETDTLD

SEQ ID NO: 3404016 - protein, 24 aa, Plasmodium falciparum
KLVSLDMSSLIAGAKYRGDFEERL

SEQ ID NO: 3404017 - protein, 22 aa, Plasmodium falciparum
KLYNVYYPFIFQIYEHLNTTIT

SEQ ID NO: 3404018 - protein, 21 aa, Plasmodium falciparum
KLYYKKEIKSIKEAKEEIVKW

SEQ ID NO: 3404019 - protein, 20 aa, Plasmodium falciparum
KMCNLRIPIYSYITNVEETL

SEQ ID NO: 3404020 - protein, 17 aa, Plasmodium falciparum
KMEPIQMYFFAKRTKKD

SEQ ID NO: 3404021 - protein, 22 aa, Plasmodium falciparum
KMHRKIVLSIFYMIADMNKTTE

SEQ ID NO: 3404022 - protein, 17 aa, Plasmodium falciparum
KMQDFYYNFQLYRNNYE

SEQ ID NO: 3404023 - protein, 20 aa, Plasmodium falciparum
KMSRKWSRWEKDNFLASLHN

SEQ ID NO: 3404024 - protein, 17 aa, Plasmodium falciparum
KNAKGLNLNKRLLHETQ

SEQ ID NO: 3404025 - protein, 18 aa, Plasmodium falciparum
KNCPLNFMNSCVRINNVN

SEQ ID NO: 3404026 - protein, 18 aa, Plasmodium falciparum
KNDITAAWCGFRPLISTN

SEQ ID NO: 3404027 - protein, 18 aa, Plasmodium falciparum
KNDIYPFFIPINNAKEDL

SEQ ID NO: 3404028 - protein, 25 aa, Plasmodium falciparum
KNDVFRTGNNFKLYFNLPNIYSLAY

SEQ ID NO: 3404029 - protein, 21 aa, Plasmodium falciparum
KNEDICFIAGIGDTNGYGWGI

SEQ ID NO: 3404030 - protein, 26 aa, Plasmodium falciparum
KNELSDFYRKQCEKHKVKVEGSRGVL

SEQ ID NO: 3404031 - protein, 18 aa, Plasmodium falciparum
KNEQNAWHAHSLKNVKPE

SEQ ID NO: 3404032 - protein, 18 aa, Plasmodium falciparum
KNFFFLNNKSCWRYKDKG

SEQ ID NO: 3404033 - protein, 18 aa, Plasmodium falciparum
KNGDKILSGFILTNKKKS

SEQ ID NO: 3404034 - protein, 18 aa, Plasmodium falciparum
KNGGMRLCDFGKSTPVYS

SEQ ID NO: 3404035 - protein, 28 aa, Plasmodium falciparum
KNGLIKQFLCDVYWKNLDFLIIDTPPGT

SEQ ID NO: 3404036 - protein, 21 aa, Plasmodium falciparum
KNIFKEYKKTNIVNIQSSNKD

SEQ ID NO: 3404037 - protein, 17 aa, Plasmodium falciparum
KNINSISGIGNVDIPKN

SEQ ID NO: 3404038 - protein, 17 aa, Plasmodium falciparum
KNIPHMDIFSLSYNKQN

SEQ ID NO: 3404039 - protein, 20 aa, Plasmodium falciparum
KNIYDLPNTISLSMLSKTIK

SEQ ID NO: 3404040 - protein, 24 aa, Plasmodium falciparum
KNKFRNAAVCLKNVDDWIVNKRGL

SEQ ID NO: 3404041 - protein, 25 aa, Plasmodium falciparum
KNKMMYFQRHELFDKIIKKTKYIPN

SEQ ID NO: 3404042 - protein, 22 aa, Plasmodium falciparum
KNKNVQMLLDMVVKYLPSPIDS

SEQ ID NO: 3404043 - protein, 20 aa, Plasmodium falciparum
KNKQPLCIIADDFSNEVLQT

SEQ ID NO: 3404044 - protein, 20 aa, Plasmodium falciparum
KNKSIVYILCIFSKDENDPY

SEQ ID NO: 3404045 - protein, 19 aa, Plasmodium falciparum
KNLGDVVLFDIVKNMPHGK

SEQ ID NO: 3404046 - protein, 19 aa, Plasmodium falciparum
KNLHKIVALRFKKLEKRLE

SEQ ID NO: 3404047 - protein, 26 aa, Plasmodium falciparum
KNLIAMRGAIKFILRIKNKGKKKSLD

SEQ ID NO: 3404048 - protein, 17 aa, Plasmodium falciparum
KNLKRYTFIEVNDDILH

SEQ ID NO: 3404049 - protein, 20 aa, Plasmodium falciparum
KNLKTRTLNYLRENKVDEPN

SEQ ID NO: 3404050 - protein, 21 aa, Plasmodium falciparum
KNNALELFKGSKFFEKFSLYD

SEQ ID NO: 3404051 - protein, 26 aa, Plasmodium falciparum
KNNGYRFLRKVNFLFFKGKKNDYEMK

SEQ ID NO: 3404052 - protein, 19 aa, Plasmodium falciparum
KNNINIFNCMKRKYDKKLS

SEQ ID NO: 3404053 - protein, 18 aa, Plasmodium falciparum
KNNKCYRYIQEALYDPNI

SEQ ID NO: 3404054 - protein, 20 aa, Plasmodium falciparum
KNNKGECIYENSCLINEGNC

SEQ ID NO: 3404055 - protein, 18 aa, Plasmodium falciparum
KNNNCALQSKSSLLSISK

SEQ ID NO: 3404056 - protein, 24 aa, Plasmodium falciparum
KNPDELYEQLKIVSNFCDTIGIKT

SEQ ID NO: 3404057 - protein, 20 aa, Plasmodium falciparum
KNRFKGSLGKIPYLYNKENM

SEQ ID NO: 3404058 - protein, 27 aa, Plasmodium falciparum
KNSAIILCFPLSFSISRQSFFFFSYKS

SEQ ID NO: 3404059 - protein, 23 aa, Plasmodium falciparum
KNSELKLPRFVGFEYYFEENYKG

SEQ ID NO: 3404060 - protein, 18 aa, Plasmodium falciparum
KNSLKWLAQKYYKDVDET

SEQ ID NO: 3404061 - protein, 20 aa, Plasmodium falciparum
KNSSFCLNQSYSIIPFNQAT

SEQ ID NO: 3404062 - protein, 23 aa, Plasmodium falciparum
KNSTGRNGDWISVAVKESSTTNK

SEQ ID NO: 3404063 - protein, 24 aa, Plasmodium falciparum
KNTKEVITWWLKRLNIDEKEKTKK

SEQ ID NO: 3404064 - protein, 18 aa, Plasmodium falciparum
KNVHISKPFNWIIDNGMK

SEQ ID NO: 3404065 - protein, 21 aa, Plasmodium falciparum
KNVRSLNGIIIHWAYTPGEVS

SEQ ID NO: 3404066 - protein, 19 aa, Plasmodium falciparum
KNYEKGLSLINLIVHSNLI

SEQ ID NO: 3404067 - protein, 24 aa, Plasmodium falciparum
KNYNFNILCPLNWKNNPDNKTCSA

SEQ ID NO: 3404068 - protein, 19 aa, Plasmodium falciparum
KNYNVCPIGWTYINNKKCL

SEQ ID NO: 3404069 - protein, 23 aa, Plasmodium falciparum
KPFPDGRSPDSFYYNTAISSFHE

SEQ ID NO: 3404070 - protein, 18 aa, Plasmodium falciparum
KPIGTFLFLGPTGVGKTE

SEQ ID NO: 3404071 - protein, 23 aa, Plasmodium falciparum
KPKCSPEPLRVYCDMDSSTSIYI

SEQ ID NO: 3404072 - protein, 25 aa, Plasmodium falciparum
KPMNCPGHCLMFKQLNVSYRSLPVR

SEQ ID NO: 3404073 - protein, 24 aa, Plasmodium falciparum
KPRVKFCVYCGTNVSVEKIKLKKY

SEQ ID NO: 3404074 - protein, 22 aa, Plasmodium falciparum
KPSSEGCLYLLKITKDSVEKYT

SEQ ID NO: 3404075 - protein, 20 aa, Plasmodium falciparum
KQFHCALAVFNHGRPNPKQT

SEQ ID NO: 3404076 - protein, 18 aa, Plasmodium falciparum
KQFYFFLYHDDINTCYRI

SEQ ID NO: 3404077 - protein, 23 aa, Plasmodium falciparum
KQIKELFPYLPNYEGKINEQDVD

SEQ ID NO: 3404078 - protein, 20 aa, Plasmodium falciparum
KQKEKILHLINDMKLLVNTS

SEQ ID NO: 3404079 - protein, 19 aa, Plasmodium falciparum
KQKRIKNFEQFRNFADKYS

SEQ ID NO: 3404080 - protein, 18 aa, Plasmodium falciparum
KQLLFKFISMFYHVPLLE

SEQ ID NO: 3404081 - protein, 19 aa, Plasmodium falciparum
KQNYITFEFNNYILEHQAL

SEQ ID NO: 3404082 - protein, 17 aa, Plasmodium falciparum
KQREEIIHDDVIYSKNN

SEQ ID NO: 3404083 - protein, 33 aa, Plasmodium falciparum
KQVFNIKSNVLWFYKLVDSVCFILGNTFKDLQN

SEQ ID NO: 3404084 - protein, 18 aa, Plasmodium falciparum
KRAHRMRLLGSMILQKIN

SEQ ID NO: 3404085 - protein, 24 aa, Plasmodium falciparum
KRAKFWLLDIYKFPSVLKYKEYKN

SEQ ID NO: 3404086 - protein, 19 aa, Plasmodium falciparum
KRDPILFLSSYMKKYNLVQ

SEQ ID NO: 3404087 - protein, 25 aa, Plasmodium falciparum
KRDSIKEIFLKALDDKKYREVFKNF

SEQ ID NO: 3404088 - protein, 20 aa, Plasmodium falciparum
KREDISLCALECDKEKIEKI

SEQ ID NO: 3404089 - protein, 19 aa, Plasmodium falciparum
KRGKGKLYLFEKEELEKYQ

SEQ ID NO: 3404090 - protein, 21 aa, Plasmodium falciparum
KRGTINIKLKDNMVISSEEVT

SEQ ID NO: 3404091 - protein, 21 aa, Plasmodium falciparum
KRICQHFKIDCNVEQRDDNVV

SEQ ID NO: 3404092 - protein, 20 aa, Plasmodium falciparum
KRIHTRDVIHTFLLLCHEIG

SEQ ID NO: 3404093 - protein, 24 aa, Plasmodium falciparum
KRIYECKECTCPSTNSSMDDMIFG

SEQ ID NO: 3404094 - protein, 20 aa, Plasmodium falciparum
KRKENELFGTNHVKQTSIHS

SEQ ID NO: 3404095 - protein, 18 aa, Plasmodium falciparum
KRKKKGIKLFKNKKNIYF

SEQ ID NO: 3404096 - protein, 19 aa, Plasmodium falciparum
KRKNINLIIDKNVINYICS

SEQ ID NO: 3404097 - protein, 28 aa, Plasmodium falciparum
KRKRAREVDTLYAYDFINLINISLNRSN

SEQ ID NO: 3404098 - protein, 20 aa, Plasmodium falciparum
KRLLNELLIEDNIKKPLMRI

SEQ ID NO: 3404099 - protein, 24 aa, Plasmodium falciparum
KRNGRGKLYILNRYVRNDIIKPHK

SEQ ID NO: 3404100 - protein, 29 aa, Plasmodium falciparum
KRNPWYVPRKCTVNNFYLCRKVENDNVNC

SEQ ID NO: 3404101 - protein, 24 aa, Plasmodium falciparum
KRRNIKNVFSLRRSVNCACFTNLL

SEQ ID NO: 3404102 - protein, 21 aa, Plasmodium falciparum
KRSKITWNEKKSHHLYCPMEC

SEQ ID NO: 3404103 - protein, 21 aa, Plasmodium falciparum
KSDRAETFVDFELKKISFSIN

SEQ ID NO: 3404104 - protein, 23 aa, Plasmodium falciparum
KSEKFKRALKFYNVNTKYVTIPL

SEQ ID NO: 3404105 - protein, 18 aa, Plasmodium falciparum
KSELENLWRCHFIYYDEM

SEQ ID NO: 3404106 - protein, 20 aa, Plasmodium falciparum
KSEMTFKLILNKPLDENTTT

SEQ ID NO: 3404107 - protein, 17 aa, Plasmodium falciparum
KSILVRNRDKILLTDNY

SEQ ID NO: 3404108 - protein, 24 aa, Plasmodium falciparum
KSINELRYLYNIYVNHNNNYRSIP

SEQ ID NO: 3404109 - protein, 22 aa, Plasmodium falciparum
KSKKYGCNELFRQKGDELDEYK

SEQ ID NO: 3404110 - protein, 26 aa, Plasmodium falciparum
KSLYRTVEKFALPMVDIVLRKQRKKY

SEQ ID NO: 3404111 - protein, 25 aa, Plasmodium falciparum
KSNFFMGMRPWRFVAIVENNILVKM

SEQ ID NO: 3404112 - protein, 25 aa, Plasmodium falciparum
KSSLYGYKHIMNFLLGNLNKHKNNI

SEQ ID NO: 3404113 - protein, 21 aa, Plasmodium falciparum
KSTLLKSLIKYYVGITINNIK

SEQ ID NO: 3404114 - protein, 18 aa, Plasmodium falciparum
KSYWLIRNSWGYYWGDEG

SEQ ID NO: 3404115 - protein, 18 aa, Plasmodium falciparum
KTAEAYRDDILYLYNKNL

SEQ ID NO: 3404116 - protein, 22 aa, Plasmodium falciparum
KTKEMIARLVYSFFMRISYLSV

SEQ ID NO: 3404117 - protein, 22 aa, Plasmodium falciparum
KTKKGCVRKVLDDTIKLSAIEI

SEQ ID NO: 3404118 - protein, 24 aa, Plasmodium falciparum
KTLACNYSLIPFHIKTKERLPLNF

SEQ ID NO: 3404119 - protein, 18 aa, Plasmodium falciparum
KTLFLILYIIILQEYVCH

SEQ ID NO: 3404120 - protein, 23 aa, Plasmodium falciparum
KTSDDRVLFLLPWENNTLVGTTD

SEQ ID NO: 3404121 - protein, 18 aa, Plasmodium falciparum
KTSWKKRDPILFLSSYMK

SEQ ID NO: 3404122 - protein, 27 aa, Plasmodium falciparum
KTYSIPNLKGFRFLKHLFQKKNLVNFV

SEQ ID NO: 3404123 - protein, 20 aa, Plasmodium falciparum
KVATFSLATNEFWRDRNTNE

SEQ ID NO: 3404124 - protein, 18 aa, Plasmodium falciparum
KVKCEVSVKIAENWGSKD

SEQ ID NO: 3404125 - protein, 18 aa, Plasmodium falciparum
KVKGFRFLKQLFQRKNLK

SEQ ID NO: 3404126 - protein, 19 aa, Plasmodium falciparum
KVKLHYATSINMFKYSVFD

SEQ ID NO: 3404127 - protein, 27 aa, Plasmodium falciparum
KVKSKDILKEYTILFFHSYNVDRFLQS

SEQ ID NO: 3404128 - protein, 19 aa, Plasmodium falciparum
KVKTDFIFYFPSEKFTFYE

SEQ ID NO: 3404129 - protein, 19 aa, Plasmodium falciparum
KVNLEYLVFLLEKISLITF

SEQ ID NO: 3404130 - protein, 17 aa, Plasmodium falciparum
KVSQTIVSVMINAYDGV

SEQ ID NO: 3404131 - protein, 19 aa, Plasmodium falciparum
KWGELFRNFVGKKEKINIV

SEQ ID NO: 3404132 - protein, 20 aa, Plasmodium falciparum
KWINFSYYINRIMNYYFHIH

SEQ ID NO: 3404133 - protein, 25 aa, Plasmodium falciparum
KYDTNCLKYKYIGNYVLEKYQMNEF

SEQ ID NO: 3404134 - protein, 19 aa, Plasmodium falciparum
KYDYSQICNVQWPLENGNI

SEQ ID NO: 3404135 - protein, 21 aa, Plasmodium falciparum
KYDYVIIMGFTLMFPSTPFNP

SEQ ID NO: 3404136 - protein, 25 aa, Plasmodium falciparum
KYFCSKEKRWPFSKKEIDFFTSDDA

SEQ ID NO: 3404137 - protein, 19 aa, Plasmodium falciparum
KYFNYEVVGIIDPFDKNRV

SEQ ID NO: 3404138 - protein, 24 aa, Plasmodium falciparum
KYGMSCNYSAIPYIDEFGLVVYNK

SEQ ID NO: 3404139 - protein, 18 aa, Plasmodium falciparum
KYIFPSINMNLTLTSLIR

SEQ ID NO: 3404140 - protein, 20 aa, Plasmodium falciparum
KYKEVCGNASDLLKKKIQDI

SEQ ID NO: 3404141 - protein, 24 aa, Plasmodium falciparum
KYLARKLQLTWGIYPHLSKKQNLF

SEQ ID NO: 3404142 - protein, 31 aa, Plasmodium falciparum
KYLIFFFKNLHVWKTDLFCQNINYMNNYLNS

SEQ ID NO: 3404143 - protein, 19 aa, Plasmodium falciparum
KYLLDIPIMKRIEFLLKGY

SEQ ID NO: 3404144 - protein, 20 aa, Plasmodium falciparum
KYLLFRCLRDDNMLNETGIN

SEQ ID NO: 3404145 - protein, 21 aa, Plasmodium falciparum
KYMDDFFLVKYINNIWINKNV

SEQ ID NO: 3404146 - protein, 34 aa, Plasmodium falciparum
KYMRTMWSELMFKEKLNLFFLIKHLEIFYKNLMA

SEQ ID NO: 3404147 - protein, 21 aa, Plasmodium falciparum
KYNCRTKFLKLIGCHDKYGIF

SEQ ID NO: 3404148 - protein, 23 aa, Plasmodium falciparum
KYNEFKKEFDIFTMNVSEYEIMK

SEQ ID NO: 3404149 - protein, 40 aa, Plasmodium falciparum
KYQCVIKSKGIKIFLCVCPNCSKHFYLLIKKGSQKKMISK

SEQ ID NO: 3404150 - protein, 19 aa, Plasmodium falciparum
KYSSPLFKKNWSYLCKSDW

SEQ ID NO: 3404151 - protein, 30 aa, Plasmodium falciparum
KYWKVLNSWGTNWGNSGYFYILRNNNSFNI

SEQ ID NO: 3404152 - protein, 30 aa, Plasmodium falciparum
KYWNYQAVVISWDYSCFAPNEWKKKSFSEY

SEQ ID NO: 3404153 - protein, 22 aa, Plasmodium falciparum
LAHLRMIYYSTVQKPTIIRKIC

SEQ ID NO: 3404154 - protein, 24 aa, Plasmodium falciparum
LASFLKTFICYSPKNVITVSPPRN

SEQ ID NO: 3404155 - protein, 18 aa, Plasmodium falciparum
LATNEFWRDRNTNELKSK

SEQ ID NO: 3404156 - protein, 17 aa, Plasmodium falciparum
LCELCIDNYQTLRNKNS

SEQ ID NO: 3404157 - protein, 25 aa, Plasmodium falciparum
LCFKIILLIIKRLRNDIILDNVITK

SEQ ID NO: 3404158 - protein, 23 aa, Plasmodium falciparum
LCHVIEIYNSILLKKEIEKKCNV

SEQ ID NO: 3404159 - protein, 25 aa, Plasmodium falciparum
LCKSEKYKFLYLIYDLRKLYEELID

SEQ ID NO: 3404160 - protein, 26 aa, Plasmodium falciparum
LCLDLDLVEGLLCRKNELPYLKKLII

SEQ ID NO: 3404161 - protein, 24 aa, Plasmodium falciparum
LCLFFIYLYIYKTYGKVKNTDEGL

SEQ ID NO: 3404162 - protein, 17 aa, Plasmodium falciparum
LCSSLLYHRYPFKSKFV

SEQ ID NO: 3404163 - protein, 27 aa, Plasmodium falciparum
LDDKKYREVFKNFMYGVYSYAKRHNYL

SEQ ID NO: 3404164 - protein, 19 aa, Plasmodium falciparum
LDELNMLKDNLINYEFILD

SEQ ID NO: 3404165 - protein, 17 aa, Plasmodium falciparum
LDFKNICIRAGHHCASL

SEQ ID NO: 3404166 - protein, 17 aa, Plasmodium falciparum
LDKIVGVSCRIKEKINP

SEQ ID NO: 3404167 - protein, 27 aa, Plasmodium falciparum
LDMNFYGIIGFNFFKNYDTFVLDTIQM

SEQ ID NO: 3404168 - protein, 21 aa, Plasmodium falciparum
LDPKLIALVIQSIVSAKVEEE

SEQ ID NO: 3404169 - protein, 17 aa, Plasmodium falciparum
LEACILKYSYPRDDQKW

SEQ ID NO: 3404170 - protein, 24 aa, Plasmodium falciparum
LEAVRKRPGMYIGNTDVKGLHQIL

SEQ ID NO: 3404171 - protein, 18 aa, Plasmodium falciparum
LEGHTCGIIPYYNELDNN

SEQ ID NO: 3404172 - protein, 30 aa, Plasmodium falciparum
LEHLRISEFLHCYYKPISYYQIKLEEEKEK

SEQ ID NO: 3404173 - protein, 17 aa, Plasmodium falciparum
LEIAGAFHSFYMFPAKE

SEQ ID NO: 3404174 - protein, 21 aa, Plasmodium falciparum
LEILKNYLYQVFKENIQKIKI

SEQ ID NO: 3404175 - protein, 24 aa, Plasmodium falciparum
LEKKWKNICFEWRRDLNDICKQIF

SEQ ID NO: 3404176 - protein, 22 aa, Plasmodium falciparum
LENKKNCSMQKGYVVEEKADGL

SEQ ID NO: 3404177 - protein, 20 aa, Plasmodium falciparum
LENLWRCHFIYYDEMLEISG

SEQ ID NO: 3404178 - protein, 19 aa, Plasmodium falciparum
LERMFKLNVLLNKGGVKKE

SEQ ID NO: 3404179 - protein, 19 aa, Plasmodium falciparum
LERNVLHIYSILRNIKNNN

SEQ ID NO: 3404180 - protein, 17 aa, Plasmodium falciparum
LESFPLDELNMLKDNLI

SEQ ID NO: 3404181 - protein, 17 aa, Plasmodium falciparum
LESTLLYFRKYKLFFKN

SEQ ID NO: 3404182 - protein, 22 aa, Plasmodium falciparum
LETLEFLNILYTHGLPKVLGVV

SEQ ID NO: 3404183 - protein, 19 aa, Plasmodium falciparum
LEYIEELFELIKEEDIKFQ

SEQ ID NO: 3404184 - protein, 26 aa, Plasmodium falciparum
LFANSVEQLFYCYNLFDVSNDSVDSF

SEQ ID NO: 3404185 - protein, 17 aa, Plasmodium falciparum
LFFENSFIRKDLHTYFI

SEQ ID NO: 3404186 - protein, 17 aa, Plasmodium falciparum
LFFFNFMIFQGKVILCV

SEQ ID NO: 3404187 - protein, 27 aa, Plasmodium falciparum
LFHIIKGPDFSTGGIIISKYDILKNIY

SEQ ID NO: 3404188 - protein, 17 aa, Plasmodium falciparum
LFHTLLFDLDVDKNLYT

SEQ ID NO: 3404189 - protein, 20 aa, Plasmodium falciparum
LFICFFVFFVHAVSSQEQPN

SEQ ID NO: 3404190 - protein, 18 aa, Plasmodium falciparum
LFIIYIIHVYPCKSGCLG

SEQ ID NO: 3404191 - protein, 18 aa, Plasmodium falciparum
LFIKISNVNIFFAEAKKN

SEQ ID NO: 3404192 - protein, 18 aa, Plasmodium falciparum
LFIKRIPIDMWLKQFEMM

SEQ ID NO: 3404193 - protein, 19 aa, Plasmodium falciparum
LFILNRLSFENAIKKTKNQ

SEQ ID NO: 3404194 - protein, 18 aa, Plasmodium falciparum
LFIWYFFFVYVKNLSILQ

SEQ ID NO: 3404195 - protein, 18 aa, Plasmodium falciparum
LFKGSKFFEKFSLYDIIT

SEQ ID NO: 3404196 - protein, 18 aa, Plasmodium falciparum
LFLFLHFYTIVCFIQNNT

SEQ ID NO: 3404197 - protein, 22 aa, Plasmodium falciparum
LFLFLISFVFESFVRSHGDLFN

SEQ ID NO: 3404198 - protein, 18 aa, Plasmodium falciparum
LFLILLNLYKCASISCEI

SEQ ID NO: 3404199 - protein, 26 aa, Plasmodium falciparum
LFLLEGLELIEYIKIALNYNDNKNMK

SEQ ID NO: 3404200 - protein, 24 aa, Plasmodium falciparum
LFNIWKKIAENFSFSFYDLPILES

SEQ ID NO: 3404201 - protein, 26 aa, Plasmodium falciparum
LFNNYKCELYICGHKSIRYKVMDILK

SEQ ID NO: 3404202 - protein, 19 aa, Plasmodium falciparum
LFQKKNLVNFVGMYENHVS

SEQ ID NO: 3404203 - protein, 19 aa, Plasmodium falciparum
LFRERSIREPLKYLHSIRD

SEQ ID NO: 3404204 - protein, 17 aa, Plasmodium falciparum
LFRKSVVSVIGVLVALL

SEQ ID NO: 3404205 - protein, 17 aa, Plasmodium falciparum
LFSFINFFFVYDVTCTK

SEQ ID NO: 3404206 - protein, 18 aa, Plasmodium falciparum
LFSKKRWVGKKIADVMTS

SEQ ID NO: 3404207 - protein, 21 aa, Plasmodium falciparum
LFTILFWLSLVSGENVNNKNC

SEQ ID NO: 3404208 - protein, 22 aa, Plasmodium falciparum
LFYQHYVCSTIKPYEIDKRDLL

SEQ ID NO: 3404209 - protein, 25 aa, Plasmodium falciparum
LGKGFKCGFNGLLHLNIIQERIKRE

SEQ ID NO: 3404210 - protein, 27 aa, Plasmodium falciparum
LGLKKGDLRNLLPLSMYYEKHKDHDRA

SEQ ID NO: 3404211 - protein, 23 aa, Plasmodium falciparum
LGYNQRLGIWFGKDKDENLNMIL

SEQ ID NO: 3404212 - protein, 18 aa, Plasmodium falciparum
LGYVLINFSCARNFIFGE

SEQ ID NO: 3404213 - protein, 26 aa, Plasmodium falciparum
LHGHCFGGNIIRIISSLSKDLWKIFQ

SEQ ID NO: 3404214 - protein, 21 aa, Plasmodium falciparum
LHGNLKLSFLTNFNERHEEML

SEQ ID NO: 3404215 - protein, 23 aa, Plasmodium falciparum
LHIYHKYFIIDFGYIYCENKKLL

SEQ ID NO: 3404216 - protein, 25 aa, Plasmodium falciparum
LHLSRKLKHCDLIGAPNRIIINLSN

SEQ ID NO: 3404217 - protein, 20 aa, Plasmodium falciparum
LHNHMLFKYLHNIFQHIDQY

SEQ ID NO: 3404218 - protein, 23 aa, Plasmodium falciparum
LIDLNFFLYNGFLRITEDKHLIN

SEQ ID NO: 3404219 - protein, 26 aa, Plasmodium falciparum
LIDPGYRAQIYLMEWALSKEGIANDL

SEQ ID NO: 3404220 - protein, 18 aa, Plasmodium falciparum
LIEFIRKEYRIRKYEEVI

SEQ ID NO: 3404221 - protein, 18 aa, Plasmodium falciparum
LIETCFDKNNFIYYIDEN

SEQ ID NO: 3404222 - protein, 19 aa, Plasmodium falciparum
LIFDLKNNILIIPKKYLNN

SEQ ID NO: 3404223 - protein, 18 aa, Plasmodium falciparum
LIFFDLFLVNGRDVQNNI

SEQ ID NO: 3404224 - protein, 22 aa, Plasmodium falciparum
LIFLYFCLYLNIKESIILGNCK

SEQ ID NO: 3404225 - protein, 17 aa, Plasmodium falciparum
LIGHSLGGLYLNFFLSR

SEQ ID NO: 3404226 - protein, 18 aa, Plasmodium falciparum
LIICSVFFFVYGFNNKFV

SEQ ID NO: 3404227 - protein, 20 aa, Plasmodium falciparum
LIKLSGYVFQNIVSTDSMPT

SEQ ID NO: 3404228 - protein, 20 aa, Plasmodium falciparum
LIKMVVCKIINYVRSDYNFM

SEQ ID NO: 3404229 - protein, 18 aa, Plasmodium falciparum
LILCVLFCKNDIKCTTVD

SEQ ID NO: 3404230 - protein, 21 aa, Plasmodium falciparum
LILFLLYLNFCACMWPWTKKW

SEQ ID NO: 3404231 - protein, 18 aa, Plasmodium falciparum
LILIFTKRCSGWCDEGHM

SEQ ID NO: 3404232 - protein, 17 aa, Plasmodium falciparum
LILSLMLNENIYYKNIP

SEQ ID NO: 3404233 - protein, 24 aa, Plasmodium falciparum
LINKNEKCFFFFFKEEKKKSDFMK

SEQ ID NO: 3404234 - protein, 17 aa, Plasmodium falciparum
LIQFIIYIYFFKTVVKS

SEQ ID NO: 3404235 - protein, 18 aa, Plasmodium falciparum
LIQKRGRKYIPFYDINKK

SEQ ID NO: 3404236 - protein, 24 aa, Plasmodium falciparum
LIQQWKYYQNMLGFEEDKDHAYLG

SEQ ID NO: 3404237 - protein, 25 aa, Plasmodium falciparum
LISKLRSLFPLFIKNNFLNNEIKNS

SEQ ID NO: 3404238 - protein, 20 aa, Plasmodium falciparum
LIVCTIINYYCAVQNNGNKS

SEQ ID NO: 3404239 - protein, 25 aa, Plasmodium falciparum
LIVLLNVCFSYLIKKKNIIINNNDN

SEQ ID NO: 3404240 - protein, 18 aa, Plasmodium falciparum
LKDIKSMLSTDDYQSFFK

SEQ ID NO: 3404241 - protein, 22 aa, Plasmodium falciparum
LKDLKKVLICSTLLEGQYGHSD

SEQ ID NO: 3404242 - protein, 25 aa, Plasmodium falciparum
LKDMKVCLEYAKYNRIYMMKIIEKI

SEQ ID NO: 3404243 - protein, 19 aa, Plasmodium falciparum
LKEDVYLGDFFFFLKRKKY

SEQ ID NO: 3404244 - protein, 17 aa, Plasmodium falciparum
LKEGFYYDIFLNNFSIN

SEQ ID NO: 3404245 - protein, 30 aa, Plasmodium falciparum
LKEHELFEIPPLIIFLRFFFHEKNEELFTF

SEQ ID NO: 3404246 - protein, 25 aa, Plasmodium falciparum
LKEICSECDCKYKDLDNTFKEFKDN

SEQ ID NO: 3404247 - protein, 17 aa, Plasmodium falciparum
LKFDKSLKNFFKQNNKN

SEQ ID NO: 3404248 - protein, 23 aa, Plasmodium falciparum
LKFILCCLLLNYILSKVYSFNNL

SEQ ID NO: 3404249 - protein, 19 aa, Plasmodium falciparum
LKGAIDLLISSFYKSDGEN

SEQ ID NO: 3404250 - protein, 17 aa, Plasmodium falciparum
LKGVYGNRIFTFDKNGK

SEQ ID NO: 3404251 - protein, 17 aa, Plasmodium falciparum
LKHFFKHKTPHVHLKKN

SEQ ID NO: 3404252 - protein, 21 aa, Plasmodium falciparum
LKILRNGNFCLSQDGHKSGSI

SEQ ID NO: 3404253 - protein, 21 aa, Plasmodium falciparum
LKKEKNIVFSISRVVDDIVFL

SEQ ID NO: 3404254 - protein, 20 aa, Plasmodium falciparum
LKKESLCFTIAGLVSNSLNQ

SEQ ID NO: 3404255 - protein, 20 aa, Plasmodium falciparum
LKKKFLPEFLNRIDEKIIFR

SEQ ID NO: 3404256 - protein, 30 aa, Plasmodium falciparum
LKKKFVRFRVTDAIDVYDFFYIKKVLSSRI

SEQ ID NO: 3404257 - protein, 22 aa, Plasmodium falciparum
LKKKKVFEFDVIFSGSDVAGEG

SEQ ID NO: 3404258 - protein, 17 aa, Plasmodium falciparum
LKKRKKYENRRYKFPKN

SEQ ID NO: 3404259 - protein, 17 aa, Plasmodium falciparum
LKKYILLNGYNFEDYIY

SEQ ID NO: 3404260 - protein, 19 aa, Plasmodium falciparum
LKLGLIKEKHMHLNDQELI

SEQ ID NO: 3404261 - protein, 20 aa, Plasmodium falciparum
LKNAEEYFHKAIRNNDDSLE

SEQ ID NO: 3404262 - protein, 21 aa, Plasmodium falciparum
LKNCRIFQLNLGNIVAGTKYR

SEQ ID NO: 3404263 - protein, 17 aa, Plasmodium falciparum
LKNEIQIFRDNLYTPMN

SEQ ID NO: 3404264 - protein, 17 aa, Plasmodium falciparum
LKNHLKDNLNFFNNSLE

SEQ ID NO: 3404265 - protein, 21 aa, Plasmodium falciparum
LKNIPSAVIYVFDPLKKDDHK

SEQ ID NO: 3404266 - protein, 19 aa, Plasmodium falciparum
LKNKNSWGTVCVKGPNFEF

SEQ ID NO: 3404267 - protein, 21 aa, Plasmodium falciparum
LKNMNAINCIEYLKDDNLLYF

SEQ ID NO: 3404268 - protein, 17 aa, Plasmodium falciparum
LKNNILIIPKKYLNNTN

SEQ ID NO: 3404269 - protein, 33 aa, Plasmodium falciparum
LKNRELKLKFEAMSRIKEYKIYNELIQKSVEIL

SEQ ID NO: 3404270 - protein, 26 aa, Plasmodium falciparum
LKNTFTHKFLENFKGDIELLKKNIQN

SEQ ID NO: 3404271 - protein, 18 aa, Plasmodium falciparum
LKPNNCFSSVYDYNEANK

SEQ ID NO: 3404272 - protein, 17 aa, Plasmodium falciparum
LKPSGGFTKEILQIIQE

SEQ ID NO: 3404273 - protein, 23 aa, Plasmodium falciparum
LKQCKNCRNALGFTKITNHTLST

SEQ ID NO: 3404274 - protein, 22 aa, Plasmodium falciparum
LKRILDMSNEYSLFITSDHLRQ

SEQ ID NO: 3404275 - protein, 23 aa, Plasmodium falciparum
LKRNESYIGVLIHDLINKGITEP

SEQ ID NO: 3404276 - protein, 19 aa, Plasmodium falciparum
LKSDIIFETFNFLKKKKNY

SEQ ID NO: 3404277 - protein, 25 aa, Plasmodium falciparum
LKSFIKLWCNNRIKFIKTNYEIKNK

SEQ ID NO: 3404278 - protein, 17 aa, Plasmodium falciparum
LKSMRAVSLSSLQKLIL

SEQ ID NO: 3404279 - protein, 20 aa, Plasmodium falciparum
LKTEFPLICTIYEISFQKKN

SEQ ID NO: 3404280 - protein, 23 aa, Plasmodium falciparum
LKTRKIIHPSIRIRNLDKKFMKC

SEQ ID NO: 3404281 - protein, 23 aa, Plasmodium falciparum
LKTTEFTIVFWIYLLERSTSHFR

SEQ ID NO: 3404282 - protein, 18 aa, Plasmodium falciparum
LKVLQMIVEKGFLPTEGD

SEQ ID NO: 3404283 - protein, 24 aa, Plasmodium falciparum
LKYEILTKICEKMQAEFREMNVLT

SEQ ID NO: 3404284 - protein, 23 aa, Plasmodium falciparum
LKYKLPIKIELFLNELNRKIEEE

SEQ ID NO: 3404285 - protein, 18 aa, Plasmodium falciparum
LLAHEKCSSSSEFSGTSF

SEQ ID NO: 3404286 - protein, 21 aa, Plasmodium falciparum
LLCFICVIFLLHKNVVRSGDN

SEQ ID NO: 3404287 - protein, 19 aa, Plasmodium falciparum
LLCVKYFLIYSKAYKKKNN

SEQ ID NO: 3404288 - protein, 18 aa, Plasmodium falciparum
LLDKNLYDLKTFKNLNAA

SEQ ID NO: 3404289 - protein, 20 aa, Plasmodium falciparum
LLEIKHYINFIFDTFGLIYG

SEQ ID NO: 3404290 - protein, 20 aa, Plasmodium falciparum
LLEKENIIFIGPTGNVMEAL

SEQ ID NO: 3404291 - protein, 21 aa, Plasmodium falciparum
LLELFYKQREEIIHDDVIYSK

SEQ ID NO: 3404292 - protein, 17 aa, Plasmodium falciparum
LLEYKSSRGHFGILSKS

SEQ ID NO: 3404293 - protein, 23 aa, Plasmodium falciparum
LLFEKPVLCNKIIILYEDQNFIC

SEQ ID NO: 3404294 - protein, 17 aa, Plasmodium falciparum
LLFILLYSSDIIISINP

SEQ ID NO: 3404295 - protein, 17 aa, Plasmodium falciparum
LLFSVINNLSICFRIYG

SEQ ID NO: 3404296 - protein, 24 aa, Plasmodium falciparum
LLHRHELPYLKKLIILDNLVKPIR

SEQ ID NO: 3404297 - protein, 17 aa, Plasmodium falciparum
LLIAIIRIDSNLVQNIL

SEQ ID NO: 3404298 - protein, 18 aa, Plasmodium falciparum
LLIKSGSIFSGYFLEKEN

SEQ ID NO: 3404299 - protein, 20 aa, Plasmodium falciparum
LLINGCSGIAVSILSSIPCH

SEQ ID NO: 3404300 - protein, 18 aa, Plasmodium falciparum
LLKNKQLLKEAISKLTLD

SEQ ID NO: 3404301 - protein, 17 aa, Plasmodium falciparum
LLLIVSLLKFISAVDSN

SEQ ID NO: 3404302 - protein, 23 aa, Plasmodium falciparum
LLLPVYFLFFWIHLNIVRSDNVC

SEQ ID NO: 3404303 - protein, 28 aa, Plasmodium falciparum
LLLVIFLLCLRYGYSIKKKRSPNNKNRL

SEQ ID NO: 3404304 - protein, 23 aa, Plasmodium falciparum
LLNEISLLAAYIVELTSSYKLSA

SEQ ID NO: 3404305 - protein, 23 aa, Plasmodium falciparum
LLNVLHICIKFSVADLPTHVETK

SEQ ID NO: 3404306 - protein, 39 aa, Plasmodium falciparum
LLNYILKLKEIYNMSTMDFIGAFLILESFNLNIINEYPL

SEQ ID NO: 3404307 - protein, 18 aa, Plasmodium falciparum
LLRKYYKEFYIIDDNNND

SEQ ID NO: 3404308 - protein, 25 aa, Plasmodium falciparum
LLRTEIIYRDFLKHFFKHKTPHVHL

SEQ ID NO: 3404309 - protein, 28 aa, Plasmodium falciparum
LLSICSYNILSIKCFENVYKRDNINNLN

SEQ ID NO: 3404310 - protein, 25 aa, Plasmodium falciparum
LLTNCSMLSEFLRERPLFSKIIYCY

SEQ ID NO: 3404311 - protein, 17 aa, Plasmodium falciparum
LMIYKKKYDFFMNENYI

SEQ ID NO: 3404312 - protein, 17 aa, Plasmodium falciparum
LMNKCHHFIREDDTMFE

SEQ ID NO: 3404313 - protein, 19 aa, Plasmodium falciparum
LNDSMKCIIDLVKNNNEKK

SEQ ID NO: 3404314 - protein, 20 aa, Plasmodium falciparum
LNFLFYVYNLFGFKYELFLS

SEQ ID NO: 3404315 - protein, 18 aa, Plasmodium falciparum
LNGIKSIVNSGCVNQDVM

SEQ ID NO: 3404316 - protein, 19 aa, Plasmodium falciparum
LNKTFNCNFKRLYDYIFYK

SEQ ID NO: 3404317 - protein, 20 aa, Plasmodium falciparum
LNLYPYYLIFPFNHIGKKEL

SEQ ID NO: 3404318 - protein, 17 aa, Plasmodium falciparum
LNLYRFKIDSYNITNDD

SEQ ID NO: 3404319 - protein, 21 aa, Plasmodium falciparum
LNMKKGLAVRGHRAQADRDLY

SEQ ID NO: 3404320 - protein, 17 aa, Plasmodium falciparum
LNNEKIYISHNVDHEQK

SEQ ID NO: 3404321 - protein, 20 aa, Plasmodium falciparum
LNNVGFRNNRILSSKENREE

SEQ ID NO: 3404322 - protein, 19 aa, Plasmodium falciparum
LNPDVWFDAHYVWEVKAAD

SEQ ID NO: 3404323 - protein, 17 aa, Plasmodium falciparum
LNQMKKSAVIFLDAKNG

SEQ ID NO: 3404324 - protein, 24 aa, Plasmodium falciparum
LNYKYDWTKFYILLFHVDNKMVAS

SEQ ID NO: 3404325 - protein, 25 aa, Plasmodium falciparum
LPFLKRCMVKGVLSLGKSPSYDITS

SEQ ID NO: 3404326 - protein, 20 aa, Plasmodium falciparum
LPHLKKLIILDTLVKYKKKG

SEQ ID NO: 3404327 - protein, 19 aa, Plasmodium falciparum
LPHLKNLIILDTLSKNKEI

SEQ ID NO: 3404328 - protein, 17 aa, Plasmodium falciparum
LPLNFIKNDLYEIKRKQ

SEQ ID NO: 3404329 - protein, 25 aa, Plasmodium falciparum
LPNSPIFLMKVCNNVRHIEIQVVGD

SEQ ID NO: 3404330 - protein, 18 aa, Plasmodium falciparum
LPNTISLSMLSKTIKIPL

SEQ ID NO: 3404331 - protein, 26 aa, Plasmodium falciparum
LPPYMRNVVFHFFKSNQFIDVTKKLI

SEQ ID NO: 3404332 - protein, 20 aa, Plasmodium falciparum
LPSEDILNLLSQNKLYLLIQ

SEQ ID NO: 3404333 - protein, 21 aa, Plasmodium falciparum
LPTEFDYPYFYALVENSCPSG

SEQ ID NO: 3404334 - protein, 19 aa, Plasmodium falciparum
LPVNACFKLSSISNMNDFF

SEQ ID NO: 3404335 - protein, 21 aa, Plasmodium falciparum
LQIIEDYGFLPAESNYPYNYV

SEQ ID NO: 3404336 - protein, 17 aa, Plasmodium falciparum
LQKNILLKSEFDNKCFN

SEQ ID NO: 3404337 - protein, 27 aa, Plasmodium falciparum
LQMDFIYKLQFTKIFNIWDIIDVEILG

SEQ ID NO: 3404338 - protein, 32 aa, Plasmodium falciparum
LQNKKMDLCISISFGEIFNCNFFKTIKSNIFS

SEQ ID NO: 3404339 - protein, 21 aa, Plasmodium falciparum
LQTRLAYPLIYPFNTTALNNE

SEQ ID NO: 3404340 - protein, 18 aa, Plasmodium falciparum
LRAKEILLDHILDPNNDP

SEQ ID NO: 3404341 - protein, 20 aa, Plasmodium falciparum
LRERIIIEIMESAKNGIDGL

SEQ ID NO: 3404342 - protein, 18 aa, Plasmodium falciparum
LRFDFSFIENINIDAITK

SEQ ID NO: 3404343 - protein, 30 aa, Plasmodium falciparum
LRIPPYVHKDIHFSLEFNNSLSLTKQNQNI

SEQ ID NO: 3404344 - protein, 24 aa, Plasmodium falciparum
LRKARPDIIMLLSLGGETYHPSSF

SEQ ID NO: 3404345 - protein, 20 aa, Plasmodium falciparum
LRKDIVPHITINNVPSNVFI

SEQ ID NO: 3404346 - protein, 22 aa, Plasmodium falciparum
LRKEKKNGTLLYAKEKEEENNT

SEQ ID NO: 3404347 - protein, 24 aa, Plasmodium falciparum
LRKINTFCTIHFLDVYELKNNLYQ

SEQ ID NO: 3404348 - protein, 18 aa, Plasmodium falciparum
LRKISSFVLDNRILFNKQ

SEQ ID NO: 3404349 - protein, 21 aa, Plasmodium falciparum
LRKNKLIPIYIEISSIGNEKP

SEQ ID NO: 3404350 - protein, 18 aa, Plasmodium falciparum
LRKSYKYYKMSAQNGNII

SEQ ID NO: 3404351 - protein, 18 aa, Plasmodium falciparum
LRNNFFFLNNYRKMISLC

SEQ ID NO: 3404352 - protein, 20 aa, Plasmodium falciparum
LRNVFIHCYYFAKPEFFYEH

SEQ ID NO: 3404353 - protein, 19 aa, Plasmodium falciparum
LRNVIYKHFIKVNIKCLKD

SEQ ID NO: 3404354 - protein, 30 aa, Plasmodium falciparum
LRNYRRLYKLYSAFYLKLPLHINTKTNKIH

SEQ ID NO: 3404355 - protein, 20 aa, Plasmodium falciparum
LRPSEVLRIHWEDINFERKE

SEQ ID NO: 3404356 - protein, 24 aa, Plasmodium falciparum
LRRHKDVFRKYNKGLLLMNRNNKY

SEQ ID NO: 3404357 - protein, 19 aa, Plasmodium falciparum
LRRSVNCACFTNLLEGLTG

SEQ ID NO: 3404358 - protein, 22 aa, Plasmodium falciparum
LRSNLLPALSPMKGLKLLLSLN

SEQ ID NO: 3404359 - protein, 18 aa, Plasmodium falciparum
LRSNNGMCLKTYKNILVL

SEQ ID NO: 3404360 - protein, 20 aa, Plasmodium falciparum
LSAPEKVMGRYLYKHNNKLL

SEQ ID NO: 3404361 - protein, 25 aa, Plasmodium falciparum
LSEYRAHKFYRRKRVSNITNDMIKK

SEQ ID NO: 3404362 - protein, 24 aa, Plasmodium falciparum
LSFLSSYIIAFSFKSTQSAHFILS

SEQ ID NO: 3404363 - protein, 23 aa, Plasmodium falciparum
LSIFFCFVTNISLEFKRKQKVEI

SEQ ID NO: 3404364 - protein, 26 aa, Plasmodium falciparum
LSKDLWKIFQREVINFKIERETLAII

SEQ ID NO: 3404365 - protein, 17 aa, Plasmodium falciparum
LSKYLFKAITNIKDPNK

SEQ ID NO: 3404366 - protein, 17 aa, Plasmodium falciparum
LSLFIFFVKGVILVVQA

SEQ ID NO: 3404367 - protein, 22 aa, Plasmodium falciparum
LSLFLLHLYIYINNVASKEIVK

SEQ ID NO: 3404368 - protein, 23 aa, Plasmodium falciparum
LSPEVAEGLSVLLNVKYYQGYGL

SEQ ID NO: 3404369 - protein, 21 aa, Plasmodium falciparum
LSRCKKWIAKQAINLRKGKNN

SEQ ID NO: 3404370 - protein, 17 aa, Plasmodium falciparum
LSRDTCRILKKFERNNS

SEQ ID NO: 3404371 - protein, 22 aa, Plasmodium falciparum
LSRIKIYWEYPPLHYNISVSTD

SEQ ID NO: 3404372 - protein, 24 aa, Plasmodium falciparum
LSSLEEFSLRNGLSPNSMGTSANI

SEQ ID NO: 3404373 - protein, 24 aa, Plasmodium falciparum
LSTMFKILTEMSFYEDSKFYETLG

SEQ ID NO: 3404374 - protein, 25 aa, Plasmodium falciparum
LSVGIAFAALSSFLLKKKPKSPVDL

SEQ ID NO: 3404375 - protein, 20 aa, Plasmodium falciparum
LSVIKFLGFEQIFKNSLTTL

SEQ ID NO: 3404376 - protein, 17 aa, Plasmodium falciparum
LSVKINTTFDSIKSKKN

SEQ ID NO: 3404377 - protein, 22 aa, Plasmodium falciparum
LTFLKRCLMKIFSSPKRKKTVV

SEQ ID NO: 3404378 - protein, 23 aa, Plasmodium falciparum
LTIFKKLLKWEIFIEAWYTQEET

SEQ ID NO: 3404379 - protein, 19 aa, Plasmodium falciparum
LTLAYKFLYGINMKQNCYK

SEQ ID NO: 3404380 - protein, 18 aa, Plasmodium falciparum
LTNFLDKFHVAINKISKS

SEQ ID NO: 3404381 - protein, 27 aa, Plasmodium falciparum
LTPTFKIKRFNVFKDFSFYIDAVKKKY

SEQ ID NO: 3404382 - protein, 27 aa, Plasmodium falciparum
LTPTFKVKRFYVFKDYAFFISQVKEIY

SEQ ID NO: 3404383 - protein, 23 aa, Plasmodium falciparum
LVADEFVEFLPRYMSFVKGVVDS

SEQ ID NO: 3404384 - protein, 17 aa, Plasmodium falciparum
LVGNDFLPHIPNIDINE

SEQ ID NO: 3404385 - protein, 23 aa, Plasmodium falciparum
LVKEIDALGGLMGKVIDKSGIHF

SEQ ID NO: 3404386 - protein, 24 aa, Plasmodium falciparum
LVKSNCVKYTIGLPPYIPWDKTTA

SEQ ID NO: 3404387 - protein, 20 aa, Plasmodium falciparum
LVNSHLFYEEHEILPSQYSD

SEQ ID NO: 3404388 - protein, 21 aa, Plasmodium falciparum
LVNYFKYDVFMVINITDIDDK

SEQ ID NO: 3404389 - protein, 18 aa, Plasmodium falciparum
LVVSLLIWKLSYSNDTRQ

SEQ ID NO: 3404390 - protein, 20 aa, Plasmodium falciparum
LWMKFFDIYGTHIIYESQLG

SEQ ID NO: 3404391 - protein, 20 aa, Plasmodium falciparum
LWNKHFYYNIALYTEYFLDN

SEQ ID NO: 3404392 - protein, 20 aa, Plasmodium falciparum
LWQNIRFLFKSKLKIRDMEY

SEQ ID NO: 3404393 - protein, 21 aa, Plasmodium falciparum
LWRHSEWRGRNVLGGGKCRNN

SEQ ID NO: 3404394 - protein, 17 aa, Plasmodium falciparum
LYDLKTFKNLNAAKKNY

SEQ ID NO: 3404395 - protein, 17 aa, Plasmodium falciparum
LYDSYAYYGKKYDYVII

SEQ ID NO: 3404396 - protein, 19 aa, Plasmodium falciparum
LYEKLTWIYDNIYMIKRYY

SEQ ID NO: 3404397 - protein, 22 aa, Plasmodium falciparum
LYESEFYRYSVFLENIDMKEIF

SEQ ID NO: 3404398 - protein, 20 aa, Plasmodium falciparum
LYFYHIYKKMKLIKREKYIY

SEQ ID NO: 3404399 - protein, 24 aa, Plasmodium falciparum
LYGIPRMYKWLTSYYPTVREELIN

SEQ ID NO: 3404400 - protein, 30 aa, Plasmodium falciparum
LYGRVKVHWFPKFMKRVITKIPDYIKVSDI

SEQ ID NO: 3404401 - protein, 17 aa, Plasmodium falciparum
LYIKRYFNEKAELKKKY

SEQ ID NO: 3404402 - protein, 26 aa, Plasmodium falciparum
LYLLFLLKFNKRFIFLKSEKITSYIN

SEQ ID NO: 3404403 - protein, 18 aa, Plasmodium falciparum
LYLNIKESIILGNCKIIL

SEQ ID NO: 3404404 - protein, 26 aa, Plasmodium falciparum
LYLVSAFIKRQWVPNNYIYFKTDTYY

SEQ ID NO: 3404405 - protein, 19 aa, Plasmodium falciparum
LYSVILFVNFCVAYGDDSM

SEQ ID NO: 3404406 - protein, 20 aa, Plasmodium falciparum
LYVGKLIFGEIFKIENDFAY

SEQ ID NO: 3404407 - protein, 18 aa, Plasmodium falciparum
LYYPEAIYLYRITLSGYM

SEQ ID NO: 3404408 - protein, 25 aa, Plasmodium falciparum
MDFELKELWDLVNIVSESQESQMKE

SEQ ID NO: 3404409 - protein, 17 aa, Plasmodium falciparum
MDIKRNWAQYIDKNINF

SEQ ID NO: 3404410 - protein, 19 aa, Plasmodium falciparum
MFGRKKKKKVLGFKTKEPQ

SEQ ID NO: 3404411 - protein, 24 aa, Plasmodium falciparum
MFLKFYLNNLYKYCNIKSIMVTNN

SEQ ID NO: 3404412 - protein, 25 aa, Plasmodium falciparum
MGISLEFFKKINWNYVYQYEMYLYD

SEQ ID NO: 3404413 - protein, 21 aa, Plasmodium falciparum
MIDNVFHYFFYVNMYDEKNKV

SEQ ID NO: 3404414 - protein, 23 aa, Plasmodium falciparum
MINRLPNVYILNTIEYILTDPKT

SEQ ID NO: 3404415 - protein, 23 aa, Plasmodium falciparum
MISNLKYNVDFNIDDINSIIDIS

SEQ ID NO: 3404416 - protein, 20 aa, Plasmodium falciparum
MKIFDIFQTIIFIQKFTENV

SEQ ID NO: 3404417 - protein, 19 aa, Plasmodium falciparum
MKLEQNIAYTIRFKSPLKR

SEQ ID NO: 3404418 - protein, 19 aa, Plasmodium falciparum
MKMIMTFKSTESGILRHKL

SEQ ID NO: 3404419 - protein, 24 aa, Plasmodium falciparum
MKPTFQWIAPTGFVGFNGKENDYI

SEQ ID NO: 3404420 - protein, 18 aa, Plasmodium falciparum
MKSILWDLNVPLLGNCRV

SEQ ID NO: 3404421 - protein, 22 aa, Plasmodium falciparum
MKSSIYKYKHLMKIFLDKYKLD

SEQ ID NO: 3404422 - protein, 18 aa, Plasmodium falciparum
MKYKEFKNIFQLSEDEEP

SEQ ID NO: 3404423 - protein, 17 aa, Plasmodium falciparum
MLARGELRCIGATTVSE

SEQ ID NO: 3404424 - protein, 21 aa, Plasmodium falciparum
MLCNFFNNYLFRESIFNLKNE

SEQ ID NO: 3404425 - protein, 26 aa, Plasmodium falciparum
MLEDWSLKCKAWWKCDHIMLSYECPD

SEQ ID NO: 3404426 - protein, 20 aa, Plasmodium falciparum
MLKDNLINYEFILDNLKTSV

SEQ ID NO: 3404427 - protein, 17 aa, Plasmodium falciparum
MLKMSILGICNITNKSI

SEQ ID NO: 3404428 - protein, 19 aa, Plasmodium falciparum
MLNLEVVGFLYAYPDIGVD

SEQ ID NO: 3404429 - protein, 17 aa, Plasmodium falciparum
MLTMLQYNFFHVIGKNY

SEQ ID NO: 3404430 - protein, 30 aa, Plasmodium falciparum
MMKNPAALHFLSFIYFYDFHKIEENKKRNE

SEQ ID NO: 3404431 - protein, 20 aa, Plasmodium falciparum
MNLTLTSLIRKSGLGNLQSY

SEQ ID NO: 3404432 - protein, 24 aa, Plasmodium falciparum
MNNRLSCGFIKSSINKALNILTNN

SEQ ID NO: 3404433 - protein, 17 aa, Plasmodium falciparum
MREEQRGNMSFKLNNLN

SEQ ID NO: 3404434 - protein, 22 aa, Plasmodium falciparum
MRLCDFAKCTPMYSYYLRHTKK

SEQ ID NO: 3404435 - protein, 17 aa, Plasmodium falciparum
MRNIWPLIYRNVKVNAI

SEQ ID NO: 3404436 - protein, 20 aa, Plasmodium falciparum
MVKDSLDKEVQWWNHAQEEQ

SEQ ID NO: 3404437 - protein, 24 aa, Plasmodium falciparum
MVLLKRYITVGGIPLQEFINNKLI

SEQ ID NO: 3404438 - protein, 20 aa, Plasmodium falciparum
MVVSFWLFYRSENFNLLRRL

SEQ ID NO: 3404439 - protein, 30 aa, Plasmodium falciparum
MYDYPFKELRRPSNLDLYDVTWYAGKIDIF

SEQ ID NO: 3404440 - protein, 39 aa, Plasmodium falciparum
MYITEFLRYSIGYQRKWIYKFVLFYIIKGSEKYILNDGN

SEQ ID NO: 3404441 - protein, 20 aa, Plasmodium falciparum
MYKINLSLNKWFKILKKKKV

SEQ ID NO: 3404442 - protein, 17 aa, Plasmodium falciparum
NAFRRVAIKHLKGGRVT

SEQ ID NO: 3404443 - protein, 18 aa, Plasmodium falciparum
NAFTIQFSSSLSRKHIST

SEQ ID NO: 3404444 - protein, 19 aa, Plasmodium falciparum
NALIKHSINIVSKRGNSKN

SEQ ID NO: 3404445 - protein, 17 aa, Plasmodium falciparum
NAPIYGEIISYSSECDA

SEQ ID NO: 3404446 - protein, 19 aa, Plasmodium falciparum
NCFTRACYNKRKYDHKISK

SEQ ID NO: 3404447 - protein, 18 aa, Plasmodium falciparum
NCMLKLQKEDSICKIKNK

SEQ ID NO: 3404448 - protein, 19 aa, Plasmodium falciparum
NCTNEFCTICCNNIDTKEE

SEQ ID NO: 3404449 - protein, 26 aa, Plasmodium falciparum
NDCWDAEILTSFGFIEVVGHADRSAY

SEQ ID NO: 3404450 - protein, 24 aa, Plasmodium falciparum
NDEILKYCINKAWRSTPKKEHTVG

SEQ ID NO: 3404451 - protein, 28 aa, Plasmodium falciparum
NDEKYVCFFCSTSLFIHNKIRSFINWPK

SEQ ID NO: 3404452 - protein, 20 aa, Plasmodium falciparum
NDEVDLYLLMDCSGSIRRHN

SEQ ID NO: 3404453 - protein, 25 aa, Plasmodium falciparum
NDIENKCILPICDMELNGIKVDLEN

SEQ ID NO: 3404454 - protein, 20 aa, Plasmodium falciparum
NDIFNSCGIIHEIKEKDMDI

SEQ ID NO: 3404455 - protein, 18 aa, Plasmodium falciparum
NDKIISISCYHKNIYIDL

SEQ ID NO: 3404456 - protein, 26 aa, Plasmodium falciparum
NDKKCKNKVCVLCCKKHDPTTSKELK

SEQ ID NO: 3404457 - protein, 22 aa, Plasmodium falciparum
NDKLKGVIVNIDYDNKRFSMST

SEQ ID NO: 3404458 - protein, 23 aa, Plasmodium falciparum
NDLYIYICLPINPICKTAIMEQQ

SEQ ID NO: 3404459 - protein, 24 aa, Plasmodium falciparum
NDQELRAMLFGLNYDPSKRNKNNK

SEQ ID NO: 3404460 - protein, 22 aa, Plasmodium falciparum
NDSEFKYSFGYYNDDTSGMSTF

SEQ ID NO: 3404461 - protein, 23 aa, Plasmodium falciparum
NDTQCKFGTCIGSFGEHHLRLYE

SEQ ID NO: 3404462 - protein, 23 aa, Plasmodium falciparum
NDWMKNKTGLLLPQLSYDLTYKN

SEQ ID NO: 3404463 - protein, 20 aa, Plasmodium falciparum
NDYLLKPSITKFMFLSYNSS

SEQ ID NO: 3404464 - protein, 17 aa, Plasmodium falciparum
NEFKYVFNYEQLAFLKC

SEQ ID NO: 3404465 - protein, 20 aa, Plasmodium falciparum
NEGLSSFGYIPLRRWTNVII

SEQ ID NO: 3404466 - protein, 22 aa, Plasmodium falciparum
NEILKISAKYGKNVKMLFQRII

SEQ ID NO: 3404467 - protein, 21 aa, Plasmodium falciparum
NEILLKHLLIAIIRIDSNLVQ

SEQ ID NO: 3404468 - protein, 18 aa, Plasmodium falciparum
NEKNRKAILLALLKNSLV

SEQ ID NO: 3404469 - protein, 18 aa, Plasmodium falciparum
NEKVFAVLFFKKSNKNIK

SEQ ID NO: 3404470 - protein, 17 aa, Plasmodium falciparum
NELCLHPSHSFEGNIIK

SEQ ID NO: 3404471 - protein, 17 aa, Plasmodium falciparum
NELRKLAKPDDNFYELS

SEQ ID NO: 3404472 - protein, 21 aa, Plasmodium falciparum
NELYLKCKNNILIKKIEIKKI

SEQ ID NO: 3404473 - protein, 19 aa, Plasmodium falciparum
NENGLCYFESCIPSIGKVA

SEQ ID NO: 3404474 - protein, 31 aa, Plasmodium falciparum
NENRPDYCYDLKSSICASAIDSYFLPNESEG

SEQ ID NO: 3404475 - protein, 17 aa, Plasmodium falciparum
NEVKDVLSILEKKDPEF

SEQ ID NO: 3404476 - protein, 23 aa, Plasmodium falciparum
NEYELIKRLILAFSNQEESGTNK

SEQ ID NO: 3404477 - protein, 21 aa, Plasmodium falciparum
NEYVLHIGVFLKGYVSKNDKV

SEQ ID NO: 3404478 - protein, 34 aa, Plasmodium falciparum
NEYYFVIYYCNWKYECMALYNAFHNILNNNYNNI

SEQ ID NO: 3404479 - protein, 20 aa, Plasmodium falciparum
NFDDPVIWRGPKKNGLIKQF

SEQ ID NO: 3404480 - protein, 20 aa, Plasmodium falciparum
NFDFFNNYNFNGGDDDDDDD

SEQ ID NO: 3404481 - protein, 21 aa, Plasmodium falciparum
NFDKFILPNQFILSSNETDIN

SEQ ID NO: 3404482 - protein, 17 aa, Plasmodium falciparum
NFDYLLKNNYIYSQIRY

SEQ ID NO: 3404483 - protein, 19 aa, Plasmodium falciparum
NFIFSFFLLIIKCDESVSN

SEQ ID NO: 3404484 - protein, 21 aa, Plasmodium falciparum
NFIPSCYENVYSLKKVTRQNI

SEQ ID NO: 3404485 - protein, 25 aa, Plasmodium falciparum
NFNIEKCFQCALLVEKENKNDVCYK

SEQ ID NO: 3404486 - protein, 24 aa, Plasmodium falciparum
NFQNWKDVWGYFSINDGFVHEFSD

SEQ ID NO: 3404487 - protein, 18 aa, Plasmodium falciparum
NFSCARNFIFGEKKSEMT

SEQ ID NO: 3404488 - protein, 17 aa, Plasmodium falciparum
NFVRKGKRILFYGCRKR

SEQ ID NO: 3404489 - protein, 17 aa, Plasmodium falciparum
NFYNLSLKYYPKMKNGK

SEQ ID NO: 3404490 - protein, 17 aa, Plasmodium falciparum
NGGYIYLSLKYAYENYL

SEQ ID NO: 3404491 - protein, 19 aa, Plasmodium falciparum
NGKIILCVHDEIIIEVNKK

SEQ ID NO: 3404492 - protein, 28 aa, Plasmodium falciparum
NGLSTICFPEYTFSYIFDTRLLRVHTLS

SEQ ID NO: 3404493 - protein, 20 aa, Plasmodium falciparum
NGMAALKCILSLKDWLFKKF

SEQ ID NO: 3404494 - protein, 19 aa, Plasmodium falciparum
NGNVLKINKMIKVEEQKKQ

SEQ ID NO: 3404495 - protein, 24 aa, Plasmodium falciparum
NGPRYCPSIAKKVMKFSEKKKHII

SEQ ID NO: 3404496 - protein, 21 aa, Plasmodium falciparum
NGRKMSLISLTEVSNKKSLNK

SEQ ID NO: 3404497 - protein, 24 aa, Plasmodium falciparum
NGRYSVQVLNGFYYPSIISGPQII

SEQ ID NO: 3404498 - protein, 18 aa, Plasmodium falciparum
NGTVKFINEEGAYIDIGC

SEQ ID NO: 3404499 - protein, 19 aa, Plasmodium falciparum
NGVNNIRGLLLWIYQYLDF

SEQ ID NO: 3404500 - protein, 19 aa, Plasmodium falciparum
NHETFNFTCIDIINHNINI

SEQ ID NO: 3404501 - protein, 18 aa, Plasmodium falciparum
NHFYNIFVKETVMLKKLY

SEQ ID NO: 3404502 - protein, 17 aa, Plasmodium falciparum
NHIKITSLLGSLMKNEN

SEQ ID NO: 3404503 - protein, 23 aa, Plasmodium falciparum
NHILNIYNFLLVWKQRKNIDLSV

SEQ ID NO: 3404504 - protein, 17 aa, Plasmodium falciparum
NHISPKMYDVYNIAETL

SEQ ID NO: 3404505 - protein, 21 aa, Plasmodium falciparum
NICFLLCVVAFVYNNVGRKRV

SEQ ID NO: 3404506 - protein, 35 aa, Plasmodium falciparum
NICILFFVVCTLNFSTKCFSNGLLKNQNILNKSFD

SEQ ID NO: 3404507 - protein, 27 aa, Plasmodium falciparum
NIENLFNIFPCFRAEFEDFYINNIYLK

SEQ ID NO: 3404508 - protein, 25 aa, Plasmodium falciparum
NIFFTGDFLFISGIGKNFEQDNEDL

SEQ ID NO: 3404509 - protein, 18 aa, Plasmodium falciparum
NIFSRFTMNINWERHLIN

SEQ ID NO: 3404510 - protein, 27 aa, Plasmodium falciparum
NIGNLFKKNELHKLLKMKKKSNNDRMT

SEQ ID NO: 3404511 - protein, 26 aa, Plasmodium falciparum
NIHSAESFIIFLWRIHNAVTLRSMYD

SEQ ID NO: 3404512 - protein, 24 aa, Plasmodium falciparum
NIKDFPKLFMFKKYVTYVQDEKFF

SEQ ID NO: 3404513 - protein, 21 aa, Plasmodium falciparum
NIKSKYGYCKIKTYNETINVN

SEQ ID NO: 3404514 - protein, 20 aa, Plasmodium falciparum
NIKSTTCFEEMIPYNKEIKW

SEQ ID NO: 3404515 - protein, 31 aa, Plasmodium falciparum
NIKVKVCLFPFDLICCNGIPVIKEPLAVRRK

SEQ ID NO: 3404516 - protein, 18 aa, Plasmodium falciparum
NILFLNFIKCDIPVHCLS

SEQ ID NO: 3404517 - protein, 19 aa, Plasmodium falciparum
NINKILCIAKILGPKKLMP

SEQ ID NO: 3404518 - protein, 26 aa, Plasmodium falciparum
NINVEKCLKCTLKVKKVEASDECYKY

SEQ ID NO: 3404519 - protein, 24 aa, Plasmodium falciparum
NISKLGKVAGCIVKKGTISINSNI

SEQ ID NO: 3404520 - protein, 22 aa, Plasmodium falciparum
NIYERFFGAGFKREEEIKKADS

SEQ ID NO: 3404521 - protein, 19 aa, Plasmodium falciparum
NIYFKRGLTHISKVKTDFI

SEQ ID NO: 3404522 - protein, 27 aa, Plasmodium falciparum
NIYIRHFIVSLFRWYNNFKLIETCFDK

SEQ ID NO: 3404523 - protein, 27 aa, Plasmodium falciparum
NIYKPVKLYSMRVCEKIKKILKDYFYK

SEQ ID NO: 3404524 - protein, 34 aa, Plasmodium falciparum
NIYNFGMWIQIHLDFGNKYIRTFINKKFVCGYET

SEQ ID NO: 3404525 - protein, 19 aa, Plasmodium falciparum
NKCIKTFIYSSSHNFHNSN

SEQ ID NO: 3404526 - protein, 27 aa, Plasmodium falciparum
NKDKNGSFIDLSMRYNEKESDNDEEEE

SEQ ID NO: 3404527 - protein, 26 aa, Plasmodium falciparum
NKDTCFLDYNYMLFLKNNNCALQSKS

SEQ ID NO: 3404528 - protein, 25 aa, Plasmodium falciparum
NKEDIKMRLGHYIKILDDAIDQKDC

SEQ ID NO: 3404529 - protein, 24 aa, Plasmodium falciparum
NKEEIKSFGIRIFIVATYGDGEPT

SEQ ID NO: 3404530 - protein, 19 aa, Plasmodium falciparum
NKGNIPFDMNLTNDISKNN

SEQ ID NO: 3404531 - protein, 22 aa, Plasmodium falciparum
NKHIEVPWNFVIEKVNVKTSEN

SEQ ID NO: 3404532 - protein, 24 aa, Plasmodium falciparum
NKHIFKSNILYNIPCLIKSSYGYN

SEQ ID NO: 3404533 - protein, 24 aa, Plasmodium falciparum
NKIKNGWLDFNICITNFKNINKIL

SEQ ID NO: 3404534 - protein, 20 aa, Plasmodium falciparum
NKILLFCLVILILYKYTYSL

SEQ ID NO: 3404535 - protein, 23 aa, Plasmodium falciparum
NKISKAGIIFRVHSNHDFLSVIL

SEQ ID NO: 3404536 - protein, 18 aa, Plasmodium falciparum
NKKCVSFISCYKRDFCYK

SEQ ID NO: 3404537 - protein, 22 aa, Plasmodium falciparum
NKKECFYKNGGIYNLSKEIRMR

SEQ ID NO: 3404538 - protein, 19 aa, Plasmodium falciparum
NKKNIYFSYCNFNDNCIVG

SEQ ID NO: 3404539 - protein, 24 aa, Plasmodium falciparum
NKKYELIDTPGILAQNLYKIKEKN

SEQ ID NO: 3404540 - protein, 24 aa, Plasmodium falciparum
NKKYKGFCETSVFKNSSFSSNMKN

SEQ ID NO: 3404541 - protein, 18 aa, Plasmodium falciparum
NKKYKGFILDGFPRNMYQ

SEQ ID NO: 3404542 - protein, 25 aa, Plasmodium falciparum
NKLPFPCIDTGMGLERITSILQNVD

SEQ ID NO: 3404543 - protein, 22 aa, Plasmodium falciparum
NKLRRKVNFAPRDIYTVNNSLD

SEQ ID NO: 3404544 - protein, 18 aa, Plasmodium falciparum
NKNIIKFRINVYCIVYIA

SEQ ID NO: 3404545 - protein, 18 aa, Plasmodium falciparum
NKPIKGLCFYSETIKNKF

SEQ ID NO: 3404546 - protein, 20 aa, Plasmodium falciparum
NKQLLKEAISKLTLDPSMMN

SEQ ID NO: 3404547 - protein, 20 aa, Plasmodium falciparum
NKRADGFGLWSLSSDNAAHN

SEQ ID NO: 3404548 - protein, 18 aa, Plasmodium falciparum
NKTGFSMKYRHASKGSKG

SEQ ID NO: 3404549 - protein, 18 aa, Plasmodium falciparum
NKTLPCYKTYTNLKTHEL

SEQ ID NO: 3404550 - protein, 17 aa, Plasmodium falciparum
NKVNIFLVPQYVTRNRN

SEQ ID NO: 3404551 - protein, 18 aa, Plasmodium falciparum
NKYFCGVLYGKYERDEFV

SEQ ID NO: 3404552 - protein, 24 aa, Plasmodium falciparum
NKYSPKGGFSISVNCGGYDDFREI

SEQ ID NO: 3404553 - protein, 18 aa, Plasmodium falciparum
NLCFKEILIRDTNETTSI

SEQ ID NO: 3404554 - protein, 18 aa, Plasmodium falciparum
NLFHVLKYLIHGENKNIL

SEQ ID NO: 3404555 - protein, 26 aa, Plasmodium falciparum
NLFLFAGVDGVRWKKPVLPGDTLTMQ

SEQ ID NO: 3404556 - protein, 18 aa, Plasmodium falciparum
NLFLIILVYIFSEKKDLR

SEQ ID NO: 3404557 - protein, 23 aa, Plasmodium falciparum
NLISFKSSLGIAKLSGVGYVNGK

SEQ ID NO: 3404558 - protein, 20 aa, Plasmodium falciparum
NLISIQLQVAMGIPLQNIDD

SEQ ID NO: 3404559 - protein, 21 aa, Plasmodium falciparum
NLLCNQCYDLLKKLSKNVKAQ

SEQ ID NO: 3404560 - protein, 18 aa, Plasmodium falciparum
NLLLCAQVKNFHKQKNIH

SEQ ID NO: 3404561 - protein, 20 aa, Plasmodium falciparum
NLLLKVAHLEKLSLIKSINK

SEQ ID NO: 3404562 - protein, 19 aa, Plasmodium falciparum
NLLLKVAHLEKLSQSIKEL

SEQ ID NO: 3404563 - protein, 24 aa, Plasmodium falciparum
NLLRPIKRLHFYLLNKKINLHSIT

SEQ ID NO: 3404564 - protein, 18 aa, Plasmodium falciparum
NLNCFDVIRLRFVKLETA

SEQ ID NO: 3404565 - protein, 18 aa, Plasmodium falciparum
NLRWEFFFNTDIMKKVIP

SEQ ID NO: 3404566 - protein, 26 aa, Plasmodium falciparum
NLTVAALKWVYTRSFITSTIIGVSDF

SEQ ID NO: 3404567 - protein, 21 aa, Plasmodium falciparum
NLVKRKFFYTNSFEIYGGASG

SEQ ID NO: 3404568 - protein, 23 aa, Plasmodium falciparum
NMKHEFYCIVGVRENFFDLAQNL

SEQ ID NO: 3404569 - protein, 19 aa, Plasmodium falciparum
NNCHMYKKNNCKKYFLNSH

SEQ ID NO: 3404570 - protein, 18 aa, Plasmodium falciparum
NNDNMLWLDLIKKNKKVN

SEQ ID NO: 3404571 - protein, 17 aa, Plasmodium falciparum
NNGMCLKTYKNILVLST

SEQ ID NO: 3404572 - protein, 17 aa, Plasmodium falciparum
NNINIHYVFSYKQNSDA

SEQ ID NO: 3404573 - protein, 22 aa, Plasmodium falciparum
NNIYPCYMKLYSGDIGGILFPK

SEQ ID NO: 3404574 - protein, 25 aa, Plasmodium falciparum
NNKAKSIPIYLGRRYSYNTFSTNSN

SEQ ID NO: 3404575 - protein, 22 aa, Plasmodium falciparum
NNKKLGNNYIIFGQDTAGSGQS

SEQ ID NO: 3404576 - protein, 25 aa, Plasmodium falciparum
NNKKYHKAFAFSGGIKSAHRRKQHL

SEQ ID NO: 3404577 - protein, 23 aa, Plasmodium falciparum
NNKLNIPVALLFSDDEIMPDINT

SEQ ID NO: 3404578 - protein, 19 aa, Plasmodium falciparum
NNLIICGGIQTYEEKDSLI

SEQ ID NO: 3404579 - protein, 17 aa, Plasmodium falciparum
NNMIKFPTNCIPFSTID

SEQ ID NO: 3404580 - protein, 18 aa, Plasmodium falciparum
NNNLCSKNAKGLNLNKRL

SEQ ID NO: 3404581 - protein, 19 aa, Plasmodium falciparum
NNNSFNIKSYILACDVNLF

SEQ ID NO: 3404582 - protein, 27 aa, Plasmodium falciparum
NNPRDSNLYLYEWLQHLNKAFLEKKKA

SEQ ID NO: 3404583 - protein, 22 aa, Plasmodium falciparum
NNSKRLSAYIIDVNKKLEYVFL

SEQ ID NO: 3404584 - protein, 17 aa, Plasmodium falciparum
NNTKLEWLCLDLDLVEG

SEQ ID NO: 3404585 - protein, 21 aa, Plasmodium falciparum
NNVKLGKVMLNQFCGKNLEKN

SEQ ID NO: 3404586 - protein, 20 aa, Plasmodium falciparum
NNVPCIRDMFFIYKRELYNI

SEQ ID NO: 3404587 - protein, 20 aa, Plasmodium falciparum
NNYSNLGFKYYIKKKKNEND

SEQ ID NO: 3404588 - protein, 23 aa, Plasmodium falciparum
NPFKRINIENAPILKGYTLNLFI

SEQ ID NO: 3404589 - protein, 23 aa, Plasmodium falciparum
NPIPSNESQPIISFPNEDDNHAQ

SEQ ID NO: 3404590 - protein, 23 aa, Plasmodium falciparum
NPNEPNWLSAIRKNPELKYEILT

SEQ ID NO: 3404591 - protein, 23 aa, Plasmodium falciparum
NPSVIHFIDLIKLGKNILERSNV

SEQ ID NO: 3404592 - protein, 23 aa, Plasmodium falciparum
NQGFPYKHINNFTYIKHVYDKNN

SEQ ID NO: 3404593 - protein, 23 aa, Plasmodium falciparum
NQGSLKLKSFDEHLKDEKIENEP

SEQ ID NO: 3404594 - protein, 21 aa, Plasmodium falciparum
NQKKYYLKFCDIDWPCEGEIQ

SEQ ID NO: 3404595 - protein, 30 aa, Plasmodium falciparum
NQKTPCEKYNYFPLIPFINTSFNWLYDQNI

SEQ ID NO: 3404596 - protein, 25 aa, Plasmodium falciparum
NQLLCGSCYIASQLYAFKRRIEVAL

SEQ ID NO: 3404597 - protein, 17 aa, Plasmodium falciparum
NQTFKFVLYFKDDILTI

SEQ ID NO: 3404598 - protein, 31 aa, Plasmodium falciparum
NRIDEKIIFRQFLKRDIINILQNMIDDLKKR

SEQ ID NO: 3404599 - protein, 17 aa, Plasmodium falciparum
NRLYCKKSANSQEKDYD

SEQ ID NO: 3404600 - protein, 24 aa, Plasmodium falciparum
NRNNRICNILKFIKYHERLYESNS

SEQ ID NO: 3404601 - protein, 21 aa, Plasmodium falciparum
NRRRPEWKGQCDKFEKEKSKY

SEQ ID NO: 3404602 - protein, 24 aa, Plasmodium falciparum
NSFFRGVVFDSFFDQYKGVVLIIK

SEQ ID NO: 3404603 - protein, 23 aa, Plasmodium falciparum
NSQGNFSPYHFIQKLARDKCHND

SEQ ID NO: 3404604 - protein, 19 aa, Plasmodium falciparum
NSRIKMGLVKYDNSDNIGG

SEQ ID NO: 3404605 - protein, 25 aa, Plasmodium falciparum
NSSIFWKNGILGFMANSIVTRDNMN

SEQ ID NO: 3404606 - protein, 28 aa, Plasmodium falciparum
NSVAHIQCLLSYGFSIYFDLHYDSTFDK

SEQ ID NO: 3404607 - protein, 19 aa, Plasmodium falciparum
NSWGNGWGKEGYFKILRGQ

SEQ ID NO: 3404608 - protein, 24 aa, Plasmodium falciparum
NSYSDILKCFSFPRKGTNDKTKEN

SEQ ID NO: 3404609 - protein, 30 aa, Plasmodium falciparum
NTDPYNHYFAWEIGGGAPTYKPENNKNDNI

SEQ ID NO: 3404610 - protein, 24 aa, Plasmodium falciparum
NTFIKPRRKTSFFINHNINVQEYL

SEQ ID NO: 3404611 - protein, 17 aa, Plasmodium falciparum
NTIFKYDYLCVFNNQNI

SEQ ID NO: 3404612 - protein, 23 aa, Plasmodium falciparum
NTIREGFDTYILIDDDNDNDTDI

SEQ ID NO: 3404613 - protein, 31 aa, Plasmodium falciparum
NTKNGKSWFCKGFPTIIPMDGFITSVKLSKF

SEQ ID NO: 3404614 - protein, 20 aa, Plasmodium falciparum
NTNFLKVYIHQHINTSFTKK

SEQ ID NO: 3404615 - protein, 18 aa, Plasmodium falciparum
NTNKKCKSILYNKDIENS

SEQ ID NO: 3404616 - protein, 24 aa, Plasmodium falciparum
NTNPKFSILFLYDKFCYGGIPLAC

SEQ ID NO: 3404617 - protein, 18 aa, Plasmodium falciparum
NTPWPCLNNEKIYISHNV

SEQ ID NO: 3404618 - protein, 18 aa, Plasmodium falciparum
NTVNRWNDEVVFICTNEN

SEQ ID NO: 3404619 - protein, 18 aa, Plasmodium falciparum
NVCNLKNISSFNVNTMNN

SEQ ID NO: 3404620 - protein, 20 aa, Plasmodium falciparum
NVFSCDLWKTSGHYQNYKDC

SEQ ID NO: 3404621 - protein, 24 aa, Plasmodium falciparum
NVFYDFQWGKDFSFEEQKYLATNY

SEQ ID NO: 3404622 - protein, 19 aa, Plasmodium falciparum
NVGKSALINRILEIKKAKS

SEQ ID NO: 3404623 - protein, 20 aa, Plasmodium falciparum
NVIYKLLLYDIFDVTFKPIS

SEQ ID NO: 3404624 - protein, 27 aa, Plasmodium falciparum
NVKDLKKEDFKSFILKYNELSSPNSNY

SEQ ID NO: 3404625 - protein, 25 aa, Plasmodium falciparum
NVLLCVLMKNYLCLLKNKRNVFYTI

SEQ ID NO: 3404626 - protein, 29 aa, Plasmodium falciparum
NVLLKSVLGFCILHGFTKLKVEAESINYE

SEQ ID NO: 3404627 - protein, 23 aa, Plasmodium falciparum
NVLYIKKEWFTLYLYTLLELLGI

SEQ ID NO: 3404628 - protein, 26 aa, Plasmodium falciparum
NVNIFLKRIFNLILREKIITAMCSDV

SEQ ID NO: 3404629 - protein, 23 aa, Plasmodium falciparum
NVNYRKKKILSILEGTLKNKRLY

SEQ ID NO: 3404630 - protein, 23 aa, Plasmodium falciparum
NVPKSIVYKKLFYSITNNEDSYL

SEQ ID NO: 3404631 - protein, 18 aa, Plasmodium falciparum
NVSLFFLLIFKYSYKNIV

SEQ ID NO: 3404632 - protein, 17 aa, Plasmodium falciparum
NVYSETFVLGGGFDISP

SEQ ID NO: 3404633 - protein, 17 aa, Plasmodium falciparum
NYEKGYIVYVINRVKMN

SEQ ID NO: 3404634 - protein, 19 aa, Plasmodium falciparum
NYFKRYIKQNTDFADETNK

SEQ ID NO: 3404635 - protein, 27 aa, Plasmodium falciparum
NYFLFDLRFIYKTGFFTKRKTIINSYL

SEQ ID NO: 3404636 - protein, 17 aa, Plasmodium falciparum
NYISFNVIFGEFKKHFN

SEQ ID NO: 3404637 - protein, 25 aa, Plasmodium falciparum
NYKKVPFYRICINGLIIETNNNLNI

SEQ ID NO: 3404638 - protein, 20 aa, Plasmodium falciparum
NYLSPETMLTMLQYNFFHVI

SEQ ID NO: 3404639 - protein, 26 aa, Plasmodium falciparum
NYNDTCLLCVPSSYITNNCFCNLIHS

SEQ ID NO: 3404640 - protein, 24 aa, Plasmodium falciparum
NYPHLRARTKLYSSLFRLKSDIIF

SEQ ID NO: 3404641 - protein, 22 aa, Plasmodium falciparum
NYRDRFDFLKGLEINIRSADDL

SEQ ID NO: 3404642 - protein, 23 aa, Plasmodium falciparum
NYRSIPFRHFYHTKIQIKSKLLK

SEQ ID NO: 3404643 - protein, 28 aa, Plasmodium falciparum
NYTAHMKFAWASSCDVIFTDRFNSYEKL

SEQ ID NO: 3404644 - protein, 21 aa, Plasmodium falciparum
NYTSLFGHRVIDFNEIKNTSN

SEQ ID NO: 3404645 - protein, 24 aa, Plasmodium falciparum
NYVFCFYGACGYDKRNVLEKIFHI

SEQ ID NO: 3404646 - protein, 22 aa, Plasmodium falciparum
NYYELLSNIIIDFRDNNMYIKK

SEQ ID NO: 3404647 - protein, 17 aa, Plasmodium falciparum
PAGNIYIGVGIYDDNYD

SEQ ID NO: 3404648 - protein, 17 aa, Plasmodium falciparum
PDLSYKKVIQILKDSIV

SEQ ID NO: 3404649 - protein, 22 aa, Plasmodium falciparum
PDSPKYKTLIEVVLEPSGNNTT

SEQ ID NO: 3404650 - protein, 22 aa, Plasmodium falciparum
PEFIKKRLEKFNEIKEKRKQEL

SEQ ID NO: 3404651 - protein, 19 aa, Plasmodium falciparum
PEFLNRIDEKIIFRQFLKR

SEQ ID NO: 3404652 - protein, 21 aa, Plasmodium falciparum
PEIKICPFNSLVNNKILFNEK

SEQ ID NO: 3404653 - protein, 22 aa, Plasmodium falciparum
PENIKKKCWLKASYEMEETLIN

SEQ ID NO: 3404654 - protein, 23 aa, Plasmodium falciparum
PENSYGLGFIKMIFVDGPYNLWI

SEQ ID NO: 3404655 - protein, 19 aa, Plasmodium falciparum
PETAQGIFVNFKKLLEYNG

SEQ ID NO: 3404656 - protein, 17 aa, Plasmodium falciparum
PFAEGVLIIGIQQATKK

SEQ ID NO: 3404657 - protein, 18 aa, Plasmodium falciparum
PFIYLIKLWASARKHNIP

SEQ ID NO: 3404658 - protein, 27 aa, Plasmodium falciparum
PFYNKTCFKSLGGKNCNNGNFNHNNNN

SEQ ID NO: 3404659 - protein, 20 aa, Plasmodium falciparum
PFYNVDRIDLLKVLRNNKLN

SEQ ID NO: 3404660 - protein, 18 aa, Plasmodium falciparum
PGILSMGISLEFFKKINW

SEQ ID NO: 3404661 - protein, 25 aa, Plasmodium falciparum
PGISKNYFKGFKLYNSREMKNLCET

SEQ ID NO: 3404662 - protein, 19 aa, Plasmodium falciparum
PIASLMFLGPTGVGKTELS

SEQ ID NO: 3404663 - protein, 17 aa, Plasmodium falciparum
PIINNLYNLCCKDKPES

SEQ ID NO: 3404664 - protein, 19 aa, Plasmodium falciparum
PIISWREQHGYILGLKLDV

SEQ ID NO: 3404665 - protein, 26 aa, Plasmodium falciparum
PILEEFKWDGIIGLGFQNGDSIKRGI

SEQ ID NO: 3404666 - protein, 19 aa, Plasmodium falciparum
PISKYWLKIDFNNLRSYWK

SEQ ID NO: 3404667 - protein, 18 aa, Plasmodium falciparum
PIVFGIRKGKFVTIHKET

SEQ ID NO: 3404668 - protein, 24 aa, Plasmodium falciparum
PIYSAKRFKGLRLYEYARKNISVQ

SEQ ID NO: 3404669 - protein, 25 aa, Plasmodium falciparum
PKGCSHSFDILSFRNFDKFLYSNKC

SEQ ID NO: 3404670 - protein, 19 aa, Plasmodium falciparum
PKLRGNVTSNIKFPSDNKG

SEQ ID NO: 3404671 - protein, 20 aa, Plasmodium falciparum
PKNYAGKCIRQKNFDHYSQS

SEQ ID NO: 3404672 - protein, 18 aa, Plasmodium falciparum
PKPLIPQRVIYKNPYLEH

SEQ ID NO: 3404673 - protein, 20 aa, Plasmodium falciparum
PKSSCISINEILCHGIPDNN

SEQ ID NO: 3404674 - protein, 17 aa, Plasmodium falciparum
PKVAVLFYYGFDYGANK

SEQ ID NO: 3404675 - protein, 17 aa, Plasmodium falciparum
PLCEKFNPFVGTFCHNN

SEQ ID NO: 3404676 - protein, 18 aa, Plasmodium falciparum
PLEPFPTQIHKDYKEKNL

SEQ ID NO: 3404677 - protein, 28 aa, Plasmodium falciparum
PLEVLKYGNGSFYKALAFDLKGGKCIDS

SEQ ID NO: 3404678 - protein, 19 aa, Plasmodium falciparum
PLIYRNVKVNAILYIINIM

SEQ ID NO: 3404679 - protein, 26 aa, Plasmodium falciparum
PLNCLWRKRTEEVIRDVIMYDYPFKE

SEQ ID NO: 3404680 - protein, 19 aa, Plasmodium falciparum
PLYYKNLCFKEILIRDTNE

SEQ ID NO: 3404681 - protein, 21 aa, Plasmodium falciparum
PNGSMHCLSCSQYEKNVNRKC

SEQ ID NO: 3404682 - protein, 21 aa, Plasmodium falciparum
PPSVVPYPIFREMEKSSIRLT

SEQ ID NO: 3404683 - protein, 19 aa, Plasmodium falciparum
PPVGFWPDVMYIIWETISK

SEQ ID NO: 3404684 - protein, 23 aa, Plasmodium falciparum
PPYLLNFKNCRDILAYTNDIDKD

SEQ ID NO: 3404685 - protein, 18 aa, Plasmodium falciparum
PQTFKVLFDTGSTNLWIP

SEQ ID NO: 3404686 - protein, 20 aa, Plasmodium falciparum
PRVISALFMYFLNKVNIFLV

SEQ ID NO: 3404687 - protein, 17 aa, Plasmodium falciparum
PSAHVTDSFSRKENPFV

SEQ ID NO: 3404688 - protein, 17 aa, Plasmodium falciparum
PSELYKIHIYINKKKID

SEQ ID NO: 3404689 - protein, 17 aa, Plasmodium falciparum
PSGRFCNFPRTSYNINE

SEQ ID NO: 3404690 - protein, 23 aa, Plasmodium falciparum
PTFEDIHYAKLVIYDDNYDKQEF

SEQ ID NO: 3404691 - protein, 24 aa, Plasmodium falciparum
PTKYEISSSLSILLGCKTNAHNYY

SEQ ID NO: 3404692 - protein, 27 aa, Plasmodium falciparum
PTLAELYLYIDKRVTIINVINNSFLYK

SEQ ID NO: 3404693 - protein, 25 aa, Plasmodium falciparum
PTLKIRRFNVFKDFSFFIDEVKKKY

SEQ ID NO: 3404694 - protein, 18 aa, Plasmodium falciparum
PTPPISCRQTGCPHTYQI

SEQ ID NO: 3404695 - protein, 17 aa, Plasmodium falciparum
PVIKEPLAVRRKLLYSL

SEQ ID NO: 3404696 - protein, 21 aa, Plasmodium falciparum
PVKNYPWEISIPFHETITREQ

SEQ ID NO: 3404697 - protein, 19 aa, Plasmodium falciparum
PVSEDIYDYITWVRDNTAV

SEQ ID NO: 3404698 - protein, 22 aa, Plasmodium falciparum
PYKLKKESLYNFSKYKEFDGLK

SEQ ID NO: 3404699 - protein, 17 aa, Plasmodium falciparum
PYLKIGRSHTLYTHITP

SEQ ID NO: 3404700 - protein, 19 aa, Plasmodium falciparum
PYNLWIINVNFFKKIFGIF

SEQ ID NO: 3404701 - protein, 21 aa, Plasmodium falciparum
PYQHFSIRWDGYLKIPESDNY

SEQ ID NO: 3404702 - protein, 18 aa, Plasmodium falciparum
PYSIILFDEIEKAHPDVY

SEQ ID NO: 3404703 - protein, 24 aa, Plasmodium falciparum
QDKIKLNIWRTFQKDELLKRILDM

SEQ ID NO: 3404704 - protein, 18 aa, Plasmodium falciparum
QDYGFSIFPVYKTFESNP

SEQ ID NO: 3404705 - protein, 21 aa, Plasmodium falciparum
QEKIVVAFLTFLKIFNQPFVF

SEQ ID NO: 3404706 - protein, 21 aa, Plasmodium falciparum
QEVLNTLNFLFYVYNLFGFKY

SEQ ID NO: 3404707 - protein, 19 aa, Plasmodium falciparum
QFTEYQWSYLNDKKWINFS

SEQ ID NO: 3404708 - protein, 30 aa, Plasmodium falciparum
QFVTIKGYNLHECLQFLVVKKNSTCGPMTI

SEQ ID NO: 3404709 - protein, 17 aa, Plasmodium falciparum
QGGLLLSSPYQYREQGG

SEQ ID NO: 3404710 - protein, 24 aa, Plasmodium falciparum
QHKNFKICGWIKSVRTVGKSYFVF

SEQ ID NO: 3404711 - protein, 23 aa, Plasmodium falciparum
QIIKSQIYRFWVSEPYLKIGRSH

SEQ ID NO: 3404712 - protein, 22 aa, Plasmodium falciparum
QIKGGDVMAMYDLGKKYKEEKN

SEQ ID NO: 3404713 - protein, 39 aa, Plasmodium falciparum
QKCPLRKVTFKGLMKATGISIPLLFGSLMLYNKIINDNS

SEQ ID NO: 3404714 - protein, 19 aa, Plasmodium falciparum
QKFTENVCASYCMNITDVL

SEQ ID NO: 3404715 - protein, 25 aa, Plasmodium falciparum
QKLLLHKGSNPYMFNNLRISNNLNN

SEQ ID NO: 3404716 - protein, 21 aa, Plasmodium falciparum
QKNIHCYVLPYAKKNIYPCKT

SEQ ID NO: 3404717 - protein, 22 aa, Plasmodium falciparum
QKNIKLDIIFIRDIERKITQNE

SEQ ID NO: 3404718 - protein, 24 aa, Plasmodium falciparum
QKPWNIPCDIAFPCATQNEINEND

SEQ ID NO: 3404719 - protein, 32 aa, Plasmodium falciparum
QKQDFSFRCNVQWSCGSSSHFSRHWQTEQIYD

SEQ ID NO: 3404720 - protein, 22 aa, Plasmodium falciparum
QKWRAKSGVIIANFSDDKNDKV

SEQ ID NO: 3404721 - protein, 26 aa, Plasmodium falciparum
QKYIMNECFKRRGIFIKKEIMNDQII

SEQ ID NO: 3404722 - protein, 27 aa, Plasmodium falciparum
QLEKLYLNGIDVFRLNFSHGLKSIKKY

SEQ ID NO: 3404723 - protein, 25 aa, Plasmodium falciparum
QLESDICTFVKYITFQLLNIDISDL

SEQ ID NO: 3404724 - protein, 26 aa, Plasmodium falciparum
QLFQRKNLKNFVGMYINLLSTEIDFL

SEQ ID NO: 3404725 - protein, 17 aa, Plasmodium falciparum
QLGTLGLILLSGQCKYK

SEQ ID NO: 3404726 - protein, 17 aa, Plasmodium falciparum
QLKEICEPQNGLIDETL

SEQ ID NO: 3404727 - protein, 23 aa, Plasmodium falciparum
QLSLECLCCSIGDVFTLNPSFRA

SEQ ID NO: 3404728 - protein, 25 aa, Plasmodium falciparum
QLYAFKRRIEVALTKKLDRKYLNNF

SEQ ID NO: 3404729 - protein, 28 aa, Plasmodium falciparum
QLYKNKCKIPLYWIKKLDNLKNMNAINC

SEQ ID NO: 3404730 - protein, 23 aa, Plasmodium falciparum
QMVFPDRLYMVGIAANNGLLLTL

SEQ ID NO: 3404731 - protein, 24 aa, Plasmodium falciparum
QNDHSFCPYNWILINEEEHICVAP

SEQ ID NO: 3404732 - protein, 18 aa, Plasmodium falciparum
QNDYKSNYILTIPRGSKT

SEQ ID NO: 3404733 - protein, 23 aa, Plasmodium falciparum
QNFPKKTLFLYSYLKDTFAKTIQ

SEQ ID NO: 3404734 - protein, 22 aa, Plasmodium falciparum
QNHLIKVDINFIQLAHLYIKRY

SEQ ID NO: 3404735 - protein, 24 aa, Plasmodium falciparum
QNSLKLYVRRVLVADEFVEFLPRY

SEQ ID NO: 3404736 - protein, 24 aa, Plasmodium falciparum
QNYMKEKYLSAILVLSPYKFSSVE

SEQ ID NO: 3404737 - protein, 20 aa, Plasmodium falciparum
QPTFPFFKNINSISGIGNVD

SEQ ID NO: 3404738 - protein, 25 aa, Plasmodium falciparum
QPVCSAYLHLCSRYYESVSIYIRLK

SEQ ID NO: 3404739 - protein, 18 aa, Plasmodium falciparum
QQFDELKFILSIDSTSVI

SEQ ID NO: 3404740 - protein, 17 aa, Plasmodium falciparum
QRDLSFYSNEQWNNDDF

SEQ ID NO: 3404741 - protein, 21 aa, Plasmodium falciparum
QRRKEIYSSNITKTFENTIPE

SEQ ID NO: 3404742 - protein, 18 aa, Plasmodium falciparum
QRVMDYFIKMFKKKNNID

SEQ ID NO: 3404743 - protein, 25 aa, Plasmodium falciparum
QSEHVIKINFNFKKENFGFMLDDIK

SEQ ID NO: 3404744 - protein, 28 aa, Plasmodium falciparum
QSRKDFISFRITKLIKLSIPESMMKALG

SEQ ID NO: 3404745 - protein, 23 aa, Plasmodium falciparum
QTYYKILLIKAYPQHLHGIQNNE

SEQ ID NO: 3404746 - protein, 23 aa, Plasmodium falciparum
QVLLKIRLLLTFQSKGIPFIYLI

SEQ ID NO: 3404747 - protein, 24 aa, Plasmodium falciparum
QYRKDGKCLNDFFDQYINDIIKQK

SEQ ID NO: 3404748 - protein, 23 aa, Plasmodium falciparum
RAEYRLFLRPDNCDIRLTPKANQ

SEQ ID NO: 3404749 - protein, 22 aa, Plasmodium falciparum
RARGYYSFFGLCRHQARSLIQK

SEQ ID NO: 3404750 - protein, 18 aa, Plasmodium falciparum
RDILNLKIRLTLPKQFSW

SEQ ID NO: 3404751 - protein, 19 aa, Plasmodium falciparum
RDKWTYLAVRDYERNEIIG

SEQ ID NO: 3404752 - protein, 17 aa, Plasmodium falciparum
RDMYFNYLVNYNRNDKE

SEQ ID NO: 3404753 - protein, 25 aa, Plasmodium falciparum
RDYNVDCPIGWSMMENGFCRAPENY

SEQ ID NO: 3404754 - protein, 19 aa, Plasmodium falciparum
RDYNVPCPEGFLVQNDNSC

SEQ ID NO: 3404755 - protein, 18 aa, Plasmodium falciparum
RDYSKCPIYFEYIKEGNY

SEQ ID NO: 3404756 - protein, 23 aa, Plasmodium falciparum
RDYVRVNCPLGWTNIGDGKCKCP

SEQ ID NO: 3404757 - protein, 19 aa, Plasmodium falciparum
REEICTLYEDMYLGRLFEN

SEQ ID NO: 3404758 - protein, 24 aa, Plasmodium falciparum
REKKTCRNFIKFSNFNKYYNEKNN

SEQ ID NO: 3404759 - protein, 19 aa, Plasmodium falciparum
REMNTSFLLYNIISQINEI

SEQ ID NO: 3404760 - protein, 21 aa, Plasmodium falciparum
REQNKYIPCSSFITHNYHMIN

SEQ ID NO: 3404761 - protein, 18 aa, Plasmodium falciparum
RESLRGMCNLVHSVDKNK

SEQ ID NO: 3404762 - protein, 18 aa, Plasmodium falciparum
REYFLICGVSPYKFKDDN

SEQ ID NO: 3404763 - protein, 20 aa, Plasmodium falciparum
REYSLIVKRILKGFNILDFL

SEQ ID NO: 3404764 - protein, 20 aa, Plasmodium falciparum
RFENDFFKKACYLNVSSQLS

SEQ ID NO: 3404765 - protein, 21 aa, Plasmodium falciparum
RFNTAIPIISYFEGMTYNLTK

SEQ ID NO: 3404766 - protein, 18 aa, Plasmodium falciparum
RGCREYFLKPSYDPINLN

SEQ ID NO: 3404767 - protein, 21 aa, Plasmodium falciparum
RGGPKTFGFRFKQIQPVKYHE

SEQ ID NO: 3404768 - protein, 18 aa, Plasmodium falciparum
RGMDYYKRLGVKRNATKE

SEQ ID NO: 3404769 - protein, 27 aa, Plasmodium falciparum
RHIAKAINFGLIYGMNYVNLKNYANTY

SEQ ID NO: 3404770 - protein, 25 aa, Plasmodium falciparum
RHVEGKWEIHLGLLKKKKNSKQKNV

SEQ ID NO: 3404771 - protein, 25 aa, Plasmodium falciparum
RIAEELRVLLNVNFYQGYGLTETTG

SEQ ID NO: 3404772 - protein, 31 aa, Plasmodium falciparum
RIAFSTKYGIPWPCKNKCTFGYDIYACPRGW

SEQ ID NO: 3404773 - protein, 26 aa, Plasmodium falciparum
RIFKIDAVKVFHHFIYSLPPYMRNVV

SEQ ID NO: 3404774 - protein, 18 aa, Plasmodium falciparum
RIKCSSLLGIDFGNEYIK

SEQ ID NO: 3404775 - protein, 26 aa, Plasmodium falciparum
RIKYNLNILKFLLKYKDLLSKEDINM

SEQ ID NO: 3404776 - protein, 18 aa, Plasmodium falciparum
RILDGLLRKGRKRKRRRN

SEQ ID NO: 3404777 - protein, 26 aa, Plasmodium falciparum
RIPIDMWLKQFEMMDTYNGEYIICAE

SEQ ID NO: 3404778 - protein, 27 aa, Plasmodium falciparum
RIPQYLRWFREWGTYVCSEYKNKFEDV

SEQ ID NO: 3404779 - protein, 24 aa, Plasmodium falciparum
RKFYKNFRKVLGKRKMKMLEDFRA

SEQ ID NO: 3404780 - protein, 17 aa, Plasmodium falciparum
RKIVPWNKARSFFYYRL

SEQ ID NO: 3404781 - protein, 24 aa, Plasmodium falciparum
RKKEIKRIIEILGRKKKSNPLLIG

SEQ ID NO: 3404782 - protein, 23 aa, Plasmodium falciparum
RKKKSLMSIIFGNLLTKYKRKKK

SEQ ID NO: 3404783 - protein, 20 aa, Plasmodium falciparum
RKQNKLFFDRNGINVPEDVA

SEQ ID NO: 3404784 - protein, 20 aa, Plasmodium falciparum
RKREHYQWNLDILGIENIYA

SEQ ID NO: 3404785 - protein, 18 aa, Plasmodium falciparum
RKRKIFVNIIDILLSIIN

SEQ ID NO: 3404786 - protein, 20 aa, Plasmodium falciparum
RKVYNLNLYNCDLIDDWDLN

SEQ ID NO: 3404787 - protein, 21 aa, Plasmodium falciparum
RKYNNCIILSRVGDFYETYGL

SEQ ID NO: 3404788 - protein, 19 aa, Plasmodium falciparum
RLAEDSIVCKVTYLEKVDV

SEQ ID NO: 3404789 - protein, 25 aa, Plasmodium falciparum
RLFYTLKLTNNFSFKNSKNRRKYTN

SEQ ID NO: 3404790 - protein, 19 aa, Plasmodium falciparum
RLKTSYIDLLQLHWPDRYY

SEQ ID NO: 3404791 - protein, 19 aa, Plasmodium falciparum
RLLLLITRVNMLINLLQTR

SEQ ID NO: 3404792 - protein, 30 aa, Plasmodium falciparum
RLSNKWCTMPMVLNEGWNIIQINLNDYTEK

SEQ ID NO: 3404793 - protein, 20 aa, Plasmodium falciparum
RMFFKNRKRGNMGINSEGDD

SEQ ID NO: 3404794 - protein, 18 aa, Plasmodium falciparum
RMQEQFLDMMCLEREKGI

SEQ ID NO: 3404795 - protein, 25 aa, Plasmodium falciparum
RNDGKFKLLGLYGSNSINWLVSDLG

SEQ ID NO: 3404796 - protein, 23 aa, Plasmodium falciparum
RNEFPHLKNLIILDTLNKSNKIN

SEQ ID NO: 3404797 - protein, 24 aa, Plasmodium falciparum
RNENILCTFSFDYGLTMKDDHTIE

SEQ ID NO: 3404798 - protein, 17 aa, Plasmodium falciparum
RNILKKQFYFFLYHDDI

SEQ ID NO: 3404799 - protein, 18 aa, Plasmodium falciparum
RNKELMGVPDKMSKRREV

SEQ ID NO: 3404800 - protein, 24 aa, Plasmodium falciparum
RNKIAKLLLFKTMQYPKSISLDTY

SEQ ID NO: 3404801 - protein, 18 aa, Plasmodium falciparum
RNVKIIFGIWPPVYNIFM

SEQ ID NO: 3404802 - protein, 20 aa, Plasmodium falciparum
RPHLSLCVFLLVCIFYPTAY

SEQ ID NO: 3404803 - protein, 21 aa, Plasmodium falciparum
RRGKSRLGSLHNYGYTSTKSV

SEQ ID NO: 3404804 - protein, 19 aa, Plasmodium falciparum
RRHSIPMLWIHDNKTVYSI

SEQ ID NO: 3404805 - protein, 18 aa, Plasmodium falciparum
RRIFPYLLRHSFATIAAT

SEQ ID NO: 3404806 - protein, 18 aa, Plasmodium falciparum
RRRFNCVTINPFTSKETY

SEQ ID NO: 3404807 - protein, 17 aa, Plasmodium falciparum
RRVAIKHLKGGRVTALR

SEQ ID NO: 3404808 - protein, 17 aa, Plasmodium falciparum
RSNAHGLIYIDGKENNT

SEQ ID NO: 3404809 - protein, 18 aa, Plasmodium falciparum
RTFFTYNGLGGLLFIIQS

SEQ ID NO: 3404810 - protein, 17 aa, Plasmodium falciparum
RTYIYMEGDTSGDEKYA

SEQ ID NO: 3404811 - protein, 18 aa, Plasmodium falciparum
RVPKILNEVTEFFNPLKV

SEQ ID NO: 3404812 - protein, 20 aa, Plasmodium falciparum
RVPLNILRKRTYVVKNKKNG

SEQ ID NO: 3404813 - protein, 18 aa, Plasmodium falciparum
RYIFLGTSFSRIHPLNFE

SEQ ID NO: 3404814 - protein, 19 aa, Plasmodium falciparum
RYIRKKTYNKLSYFNLPSL

SEQ ID NO: 3404815 - protein, 29 aa, Plasmodium falciparum
RYLLNSKPFRIWISLSRLLSIQSNIYCTF

SEQ ID NO: 3404816 - protein, 28 aa, Plasmodium falciparum
RYSEELVEGSKLFFLSGIQNNRYNKTEI

SEQ ID NO: 3404817 - protein, 20 aa, Plasmodium falciparum
SAFGGGLPFSGYSPLQGNHN

SEQ ID NO: 3404818 - protein, 34 aa, Plasmodium falciparum
SAPLIMTIILNFFKKYMAENKFNLPMSSEVENKI

SEQ ID NO: 3404819 - protein, 19 aa, Plasmodium falciparum
SAYPSDPIKIIGYNKNSVP

SEQ ID NO: 3404820 - protein, 23 aa, Plasmodium falciparum
SCADKYMLGIVFIAIWNNSYLWY

SEQ ID NO: 3404821 - protein, 25 aa, Plasmodium falciparum
SCLLASVCTLCICRNRELFPHISEN

SEQ ID NO: 3404822 - protein, 19 aa, Plasmodium falciparum
SCYANSASFIINSRVRIKY

SEQ ID NO: 3404823 - protein, 22 aa, Plasmodium falciparum
SDHGFFKYGWDLLPTPIDLRYL

SEQ ID NO: 3404824 - protein, 20 aa, Plasmodium falciparum
SDILKLGILPGDSYNFPAND

SEQ ID NO: 3404825 - protein, 17 aa, Plasmodium falciparum
SDKYIPLIFNPTKDVFT

SEQ ID NO: 3404826 - protein, 29 aa, Plasmodium falciparum
SDLEVCKFLNCPVVTPSGIKGLIKNKINN

SEQ ID NO: 3404827 - protein, 21 aa, Plasmodium falciparum
SEAKHMTEIFIKLFKDKEYHE

SEQ ID NO: 3404828 - protein, 17 aa, Plasmodium falciparum
SEELYKLSEEEYNKQYG

SEQ ID NO: 3404829 - protein, 21 aa, Plasmodium falciparum
SEGCAKHGYARIFSEQQTFRD

SEQ ID NO: 3404830 - protein, 19 aa, Plasmodium falciparum
SEKFTFYESVFTRIHIIIL

SEQ ID NO: 3404831 - protein, 18 aa, Plasmodium falciparum
SEKHFYARMEPLSVKDEN

SEQ ID NO: 3404832 - protein, 17 aa, Plasmodium falciparum
SEKKGKVFSEFSEEEDS

SEQ ID NO: 3404833 - protein, 24 aa, Plasmodium falciparum
SEKKVWAQICDINWSCYDKNYNFN

SEQ ID NO: 3404834 - protein, 17 aa, Plasmodium falciparum
SEKWKASEWNNMFNHIR

SEQ ID NO: 3404835 - protein, 23 aa, Plasmodium falciparum
SENCKLVLHNAVLEAKRKRKIFV

SEQ ID NO: 3404836 - protein, 17 aa, Plasmodium falciparum
SENKIVWVMPNTPCLVG

SEQ ID NO: 3404837 - protein, 25 aa, Plasmodium falciparum
SENRNKRIGGPKLRGNVTSNIKFPS

SEQ ID NO: 3404838 - protein, 17 aa, Plasmodium falciparum
SEPFPFNLMFQTKIGPK

SEQ ID NO: 3404839 - protein, 17 aa, Plasmodium falciparum
SEPYLKIGRSHTLYTHI

SEQ ID NO: 3404840 - protein, 21 aa, Plasmodium falciparum
SEYHLNLVFYNWFKNSKLKTK

SEQ ID NO: 3404841 - protein, 18 aa, Plasmodium falciparum
SFDKFKWIQDNLFGGGFY

SEQ ID NO: 3404842 - protein, 22 aa, Plasmodium falciparum
SFECIRLNKIIQYSLAVNKLDL

SEQ ID NO: 3404843 - protein, 30 aa, Plasmodium falciparum
SFFFFLFPVFCFFQCYGIYKNKKISKAFLI

SEQ ID NO: 3404844 - protein, 23 aa, Plasmodium falciparum
SFFLFCMVHFVFCDKNTFPKEII

SEQ ID NO: 3404845 - protein, 18 aa, Plasmodium falciparum
SFGQELIKSLSLTLKNVP

SEQ ID NO: 3404846 - protein, 28 aa, Plasmodium falciparum
SFISCYKRDFCYKKLLNKRICHLFEKNN

SEQ ID NO: 3404847 - protein, 18 aa, Plasmodium falciparum
SFLTEYYPGIAPKLYKVL

SEQ ID NO: 3404848 - protein, 19 aa, Plasmodium falciparum
SFPLALSMLVLTQYSNHEK

SEQ ID NO: 3404849 - protein, 18 aa, Plasmodium falciparum
SFQIDTLYMKRKRAREVD

SEQ ID NO: 3404850 - protein, 20 aa, Plasmodium falciparum
SFSRIHPLNFEYFLRKLNKY

SEQ ID NO: 3404851 - protein, 17 aa, Plasmodium falciparum
SGDTCKGYVQPVSLTSS

SEQ ID NO: 3404852 - protein, 24 aa, Plasmodium falciparum
SGEGIFKNRVLNPFHYQSEKRKIM

SEQ ID NO: 3404853 - protein, 25 aa, Plasmodium falciparum
SGIEYLVKLCESFISKVTNKVIKKS

SEQ ID NO: 3404854 - protein, 27 aa, Plasmodium falciparum
SGKFEKHECIIFPFIKKVDEINMIETN

SEQ ID NO: 3404855 - protein, 22 aa, Plasmodium falciparum
SGSICAIHLWRHSEWRGRNVLG

SEQ ID NO: 3404856 - protein, 19 aa, Plasmodium falciparum
SGTYKGRTYIYMEGDTSGD

SEQ ID NO: 3404857 - protein, 25 aa, Plasmodium falciparum
SHEELFKVFLELINKNDLVKENLKK

SEQ ID NO: 3404858 - protein, 21 aa, Plasmodium falciparum
SHGDICFKKADKGLCLIYLKE

SEQ ID NO: 3404859 - protein, 24 aa, Plasmodium falciparum
SHIKKQRCARLYSISSSNNMENLS

SEQ ID NO: 3404860 - protein, 24 aa, Plasmodium falciparum
SHIYERVVFFIALFLGVKINIWSR

SEQ ID NO: 3404861 - protein, 24 aa, Plasmodium falciparum
SHIYMIRKNVTFFGLRNNKIKKPK

SEQ ID NO: 3404862 - protein, 22 aa, Plasmodium falciparum
SHMPHFKFSKVFKELIKQNVKV

SEQ ID NO: 3404863 - protein, 19 aa, Plasmodium falciparum
SHNIFYYIINNIFNNIRMF

SEQ ID NO: 3404864 - protein, 24 aa, Plasmodium falciparum
SHSQIRIKCNFHFIDNWDNQTAYM

SEQ ID NO: 3404865 - protein, 24 aa, Plasmodium falciparum
SHVNFCLLNPKTLEEFLKKKEIKD

SEQ ID NO: 3404866 - protein, 18 aa, Plasmodium falciparum
SIASMVLTTECMMVDHEK

SEQ ID NO: 3404867 - protein, 17 aa, Plasmodium falciparum
SICPLEWTMKNEEYCIS

SEQ ID NO: 3404868 - protein, 26 aa, Plasmodium falciparum
SIDTLKKFLIGFSVMEFQSFESSGKF

SEQ ID NO: 3404869 - protein, 18 aa, Plasmodium falciparum
SIEGYVYGSKIYKNQKVH

SEQ ID NO: 3404870 - protein, 20 aa, Plasmodium falciparum
SIFLRNPYKITLGKSEKKGK

SEQ ID NO: 3404871 - protein, 23 aa, Plasmodium falciparum
SIKCSHCKDIYKKYMMPKTHYHL

SEQ ID NO: 3404872 - protein, 19 aa, Plasmodium falciparum
SINEFIKYAIKYVTHKKGK

SEQ ID NO: 3404873 - protein, 24 aa, Plasmodium falciparum
SIYDEGLCIYNILKDIEIKDVKRV

SEQ ID NO: 3404874 - protein, 21 aa, Plasmodium falciparum
SKDQLEDMVKNFGGKPSAHVT

SEQ ID NO: 3404875 - protein, 23 aa, Plasmodium falciparum
SKFMHKYCLQNNLLSKVDMYNEP

SEQ ID NO: 3404876 - protein, 24 aa, Plasmodium falciparum
SKFTRPWLLKYNVNYEKVKKAVEK

SEQ ID NO: 3404877 - protein, 17 aa, Plasmodium falciparum
SKFYLVHNPLFNPLDNL

SEQ ID NO: 3404878 - protein, 28 aa, Plasmodium falciparum
SKGLITKVCDSYCFIKVLKNGSTGYLHK

SEQ ID NO: 3404879 - protein, 17 aa, Plasmodium falciparum
SKHAFKKGYRSKLDPNL

SEQ ID NO: 3404880 - protein, 17 aa, Plasmodium falciparum
SKKEFQNLFLYNNDIYN

SEQ ID NO: 3404881 - protein, 21 aa, Plasmodium falciparum
SKKLSYIYILFHYKDENNFNA

SEQ ID NO: 3404882 - protein, 21 aa, Plasmodium falciparum
SKKRRIIKEIYEYSKKEENDD

SEQ ID NO: 3404883 - protein, 19 aa, Plasmodium falciparum
SKLIICKALDEHKLGRLGD

SEQ ID NO: 3404884 - protein, 23 aa, Plasmodium falciparum
SKSDLLLSAVMKFEKNFNIYHNI

SEQ ID NO: 3404885 - protein, 34 aa, Plasmodium falciparum
SKSLPIYLLPYLERFKKIHLWLDFDKAGKSSVFN

SEQ ID NO: 3404886 - protein, 19 aa, Plasmodium falciparum
SKSPICKSAIHSGILTING

SEQ ID NO: 3404887 - protein, 25 aa, Plasmodium falciparum
SKVFKHCTKIMRIGGKVSSVPFNYE

SEQ ID NO: 3404888 - protein, 20 aa, Plasmodium falciparum
SKVKCNLCVYTEIVNNKHIR

SEQ ID NO: 3404889 - protein, 26 aa, Plasmodium falciparum
SKYNFSINCNVSWPCSKICIEDFSKK

SEQ ID NO: 3404890 - protein, 24 aa, Plasmodium falciparum
SLDIKLPYEGSFGIIFKYKDDKNY

SEQ ID NO: 3404891 - protein, 30 aa, Plasmodium falciparum
SLFDILPYREYYKRDQVVILINMSNTPIDE

SEQ ID NO: 3404892 - protein, 18 aa, Plasmodium falciparum
SLFIYKPIMKLLLKKYRL

SEQ ID NO: 3404893 - protein, 48 aa, Plasmodium falciparum
SLKDIKIKMLRKLGVSYSRLPPIIKHTEGKCAIKDIIISISSKELAQR

SEQ ID NO: 3404894 - protein, 23 aa, Plasmodium falciparum
SLLKLHFDNIFLFNSTVTKEDQT

SEQ ID NO: 3404895 - protein, 18 aa, Plasmodium falciparum
SLNAFSFKSLFTKNTYNR

SEQ ID NO: 3404896 - protein, 26 aa, Plasmodium falciparum
SLNSCRTVFENLRLCNIYDTNKKIIR

SEQ ID NO: 3404897 - protein, 32 aa, Plasmodium falciparum
SLYLFFFISYAEIIFCIRIKRNNLYNFQNMTN

SEQ ID NO: 3404898 - protein, 19 aa, Plasmodium falciparum
SNECSCLFKTLKDFEKNCS

SEQ ID NO: 3404899 - protein, 17 aa, Plasmodium falciparum
SNETFSLIIKKLQEKSI

SEQ ID NO: 3404900 - protein, 17 aa, Plasmodium falciparum
SNISVPLGSFFFPEMKR

SEQ ID NO: 3404901 - protein, 20 aa, Plasmodium falciparum
SNITAAFYMNIKPIKVDEEN

SEQ ID NO: 3404902 - protein, 19 aa, Plasmodium falciparum
SNIYCTFDTIRLKYDEKKN

SEQ ID NO: 3404903 - protein, 24 aa, Plasmodium falciparum
SNNINLKSIILFSNEFNKIQKLSN

SEQ ID NO: 3404904 - protein, 24 aa, Plasmodium falciparum
SNTFFKFEFCEATSTFSSIGENGL

SEQ ID NO: 3404905 - protein, 18 aa, Plasmodium falciparum
SNYILTIPRGSKTFKKIL

SEQ ID NO: 3404906 - protein, 21 aa, Plasmodium falciparum
SPKESKDILSLTVKKKQYCIH

SEQ ID NO: 3404907 - protein, 19 aa, Plasmodium falciparum
SPRRKGRNLILKKSNVEDE

SEQ ID NO: 3404908 - protein, 17 aa, Plasmodium falciparum
SQIFNCKCKYVYEDGTQ

SEQ ID NO: 3404909 - protein, 18 aa, Plasmodium falciparum
SRELRKISSFVLDNRILF

SEQ ID NO: 3404910 - protein, 23 aa, Plasmodium falciparum
SRIGESFTTYYAIGKSENIYNIL

SEQ ID NO: 3404911 - protein, 26 aa, Plasmodium falciparum
SRISKNIRLYFCEWGYNTFEEKQKAL

SEQ ID NO: 3404912 - protein, 18 aa, Plasmodium falciparum
SRKAQIFHVLKHIKNSRI

SEQ ID NO: 3404913 - protein, 17 aa, Plasmodium falciparum
SRRACGKIEGGLENYDG

SEQ ID NO: 3404914 - protein, 22 aa, Plasmodium falciparum
SRVRIKYNYIKNIDSLFFSNEQ

SEQ ID NO: 3404915 - protein, 21 aa, Plasmodium falciparum
SRYFPTKDMPSLEDNFYEHLK

SEQ ID NO: 3404916 - protein, 27 aa, Plasmodium falciparum
SRYSGYWKIIYDEGLYIEVYKEDDSKE

SEQ ID NO: 3404917 - protein, 22 aa, Plasmodium falciparum
SRYTLLSGMVVSFWLFYRSENF

SEQ ID NO: 3404918 - protein, 21 aa, Plasmodium falciparum
SSFGFLLCGLFLLLNNNVFQK

SEQ ID NO: 3404919 - protein, 26 aa, Plasmodium falciparum
SSGTCCGCIPFTFSPAVTPTIASTTA

SEQ ID NO: 3404920 - protein, 23 aa, Plasmodium falciparum
SSHYLNSRFSRILSSANNGNEYD

SEQ ID NO: 3404921 - protein, 23 aa, Plasmodium falciparum
SSISFMKDCLIDMVHEAQEKGDD

SEQ ID NO: 3404922 - protein, 22 aa, Plasmodium falciparum
SSKELYHLCSILIQQIQKRYML

SEQ ID NO: 3404923 - protein, 21 aa, Plasmodium falciparum
SSKLLISICGGLNIGKLEEMV

SEQ ID NO: 3404924 - protein, 30 aa, Plasmodium falciparum
SSLKKLCLGKCKKRSYSIIVHSNNNNNNHN

SEQ ID NO: 3404925 - protein, 22 aa, Plasmodium falciparum
SSLKNKCYIMRIGNSYANLSTM

SEQ ID NO: 3404926 - protein, 19 aa, Plasmodium falciparum
SSSGSCVNSLWSRNLSEPN

SEQ ID NO: 3404927 - protein, 18 aa, Plasmodium falciparum
SSTNFILWPDNWTISNTK

SEQ ID NO: 3404928 - protein, 20 aa, Plasmodium falciparum
SSVPSSFLFDIPEGSEYEHM

SEQ ID NO: 3404929 - protein, 20 aa, Plasmodium falciparum
SSYNLPIIFVIENNNWAIGM

SEQ ID NO: 3404930 - protein, 20 aa, Plasmodium falciparum
STPGEYNICLAQFYQDPEKD

SEQ ID NO: 3404931 - protein, 21 aa, Plasmodium falciparum
STPPLKRMDEVFDDVLKHLNK

SEQ ID NO: 3404932 - protein, 24 aa, Plasmodium falciparum
STPQNLKWNYFYYLLKNGLNTDYN

SEQ ID NO: 3404933 - protein, 30 aa, Plasmodium falciparum
STSLFLKNNVCPLQLLKDNVKTFLNYKKEN

SEQ ID NO: 3404934 - protein, 17 aa, Plasmodium falciparum
STSLKYKLMEAKNNLNK

SEQ ID NO: 3404935 - protein, 19 aa, Plasmodium falciparum
STYDFLNFKYMIILFHDSY

SEQ ID NO: 3404936 - protein, 18 aa, Plasmodium falciparum
SVENDIHMLRKVYQRDSE

SEQ ID NO: 3404937 - protein, 17 aa, Plasmodium falciparum
SVFKLNLFASSYVSPII

SEQ ID NO: 3404938 - protein, 25 aa, Plasmodium falciparum
SVHNWKITNEFGIQRIHFNNDYKKS

SEQ ID NO: 3404939 - protein, 19 aa, Plasmodium falciparum
SVKLPRFVGFEYYFEENYK

SEQ ID NO: 3404940 - protein, 17 aa, Plasmodium falciparum
SVLNKFFVTAAIRNNYY

SEQ ID NO: 3404941 - protein, 32 aa, Plasmodium falciparum
SVLNKLKDLLLRLLYKAYVSYKKRKAQEKGLP

SEQ ID NO: 3404942 - protein, 22 aa, Plasmodium falciparum
SVNGNGFVWTLLGVHKKKPLID

SEQ ID NO: 3404943 - protein, 23 aa, Plasmodium falciparum
SVNRCFIPFISEYIYKQKNRKNN

SEQ ID NO: 3404944 - protein, 23 aa, Plasmodium falciparum
SVSKRVLEVLVRFYREKYNYEWI

SEQ ID NO: 3404945 - protein, 26 aa, Plasmodium falciparum
SVYVNEIINILSFFTFNSEHNLKYNE

SEQ ID NO: 3404946 - protein, 23 aa, Plasmodium falciparum
SYHIIFKIFMYFKTDQFYYHLFL

SEQ ID NO: 3404947 - protein, 28 aa, Plasmodium falciparum
SYKKGMCVMSICYCFNYYSLNIYTNNII

SEQ ID NO: 3404948 - protein, 18 aa, Plasmodium falciparum
SYTPWSDWSACKNNTQKR

SEQ ID NO: 3404949 - protein, 19 aa, Plasmodium falciparum
TAIIEYLSYLILKDNVPYH

SEQ ID NO: 3404950 - protein, 25 aa, Plasmodium falciparum
TAKRKIPSLYLFKNVNSYNKINKRK

SEQ ID NO: 3404951 - protein, 24 aa, Plasmodium falciparum
TCEEKTSPGLCLSKLDTNNECYFC

SEQ ID NO: 3404952 - protein, 19 aa, Plasmodium falciparum
TCLNFLVLHLEYVKCKNLS

SEQ ID NO: 3404953 - protein, 35 aa, Plasmodium falciparum
TCNVIGFLGIMKIFFKKLFFDFNIFSKNNKKNIFT

SEQ ID NO: 3404954 - protein, 20 aa, Plasmodium falciparum
TDCACMISGVTTLVMHSKFS

SEQ ID NO: 3404955 - protein, 25 aa, Plasmodium falciparum
TDDAIECFGELKGSIGKKQNVELCV

SEQ ID NO: 3404956 - protein, 23 aa, Plasmodium falciparum
TDEAIKAILKRKFEKTKKDKDGK

SEQ ID NO: 3404957 - protein, 26 aa, Plasmodium falciparum
TDEEKRILHISGVFKEFYVDVDNLNK

SEQ ID NO: 3404958 - protein, 22 aa, Plasmodium falciparum
TDEIGIPFAVTIDFQTLKDKTI

SEQ ID NO: 3404959 - protein, 25 aa, Plasmodium falciparum
TDFLKLQHEYVFKFSVYNCNMILTY

SEQ ID NO: 3404960 - protein, 22 aa, Plasmodium falciparum
TDNAVEFFKWLKSLNNDNDYFR

SEQ ID NO: 3404961 - protein, 24 aa, Plasmodium falciparum
TDTFLQKLIMEYYDERKRRTFFDD

SEQ ID NO: 3404962 - protein, 17 aa, Plasmodium falciparum
TELLKKRLDLHMDNDEQ

SEQ ID NO: 3404963 - protein, 17 aa, Plasmodium falciparum
TEYYPGIAPKLYKVLIE

SEQ ID NO: 3404964 - protein, 22 aa, Plasmodium falciparum
TFKDDAYNHWVRVMKNEESKYF

SEQ ID NO: 3404965 - protein, 17 aa, Plasmodium falciparum
TFKEFKDNVTLLKAVID

SEQ ID NO: 3404966 - protein, 21 aa, Plasmodium falciparum
TFYEKVCSFSHSLDTYGGKGI

SEQ ID NO: 3404967 - protein, 21 aa, Plasmodium falciparum
TFYFFCCYKCEKFKDSSFQSQ

SEQ ID NO: 3404968 - protein, 18 aa, Plasmodium falciparum
TGKECIKCLPDNFCECEC

SEQ ID NO: 3404969 - protein, 18 aa, Plasmodium falciparum
TGKNFKLVVYIKENTLIL

SEQ ID NO: 3404970 - protein, 25 aa, Plasmodium falciparum
TGNSYCHRCGYKGSFYDFKLKMGDL

SEQ ID NO: 3404971 - protein, 22 aa, Plasmodium falciparum
TGRGKLGSIPVGFIAVNKNLVT

SEQ ID NO: 3404972 - protein, 20 aa, Plasmodium falciparum
TIIIPYGIPSTRTIKIEFLN

SEQ ID NO: 3404973 - protein, 17 aa, Plasmodium falciparum
TILKRYIERSKKIYEKS

SEQ ID NO: 3404974 - protein, 20 aa, Plasmodium falciparum
TINLPQPYGISIDSKSSTNN

SEQ ID NO: 3404975 - protein, 18 aa, Plasmodium falciparum
TIRCMKGYEPTKISALYV

SEQ ID NO: 3404976 - protein, 17 aa, Plasmodium falciparum
TIVSLSFNVHDNLSGVY

SEQ ID NO: 3404977 - protein, 20 aa, Plasmodium falciparum
TKGWIGDQFFNYTSSCGGIN

SEQ ID NO: 3404978 - protein, 27 aa, Plasmodium falciparum
TKNEILYKREFETLINSVRIAWKALTN

SEQ ID NO: 3404979 - protein, 22 aa, Plasmodium falciparum
TKPLFYNCYVFKDHGNKIQQGC

SEQ ID NO: 3404980 - protein, 18 aa, Plasmodium falciparum
TKQILCLHKGELRNENDN

SEQ ID NO: 3404981 - protein, 20 aa, Plasmodium falciparum
TKRCSGWCDEGHMLVSAIAY

SEQ ID NO: 3404982 - protein, 19 aa, Plasmodium falciparum
TKRVTQSYVSPDISVTNPV

SEQ ID NO: 3404983 - protein, 17 aa, Plasmodium falciparum
TLAEFTALGVLFSLLPS

SEQ ID NO: 3404984 - protein, 23 aa, Plasmodium falciparum
TLEQLSFLFSRYITEHANIKDFP

SEQ ID NO: 3404985 - protein, 25 aa, Plasmodium falciparum
TLFYLSLFFSYTFKGLKCTRIYKIG

SEQ ID NO: 3404986 - protein, 24 aa, Plasmodium falciparum
TLKIRRFNVFKDFSFYIDQVKKKY

SEQ ID NO: 3404987 - protein, 30 aa, Plasmodium falciparum
TLLKILIGLCIKLGYKRFMIYSENTFVISS

SEQ ID NO: 3404988 - protein, 24 aa, Plasmodium falciparum
TLLLCGSSGVGKTLCAQVISKYLF

SEQ ID NO: 3404989 - protein, 20 aa, Plasmodium falciparum
TLNLEIAKVFNGLLNVILKW

SEQ ID NO: 3404990 - protein, 28 aa, Plasmodium falciparum
TLNMKGKMVLQYLVHLKFLTQEKKNQLK

SEQ ID NO: 3404991 - protein, 23 aa, Plasmodium falciparum
TLYAGSCLMDLMGDGLIVNVTND

SEQ ID NO: 3404992 - protein, 18 aa, Plasmodium falciparum
TNDKEVKENCSINYEEIR

SEQ ID NO: 3404993 - protein, 21 aa, Plasmodium falciparum
TNEQLKNFLGQNGTYHMSYDS

SEQ ID NO: 3404994 - protein, 30 aa, Plasmodium falciparum
TNKEMYDILNAYFFYPSYNAYRTYVNEYFL

SEQ ID NO: 3404995 - protein, 22 aa, Plasmodium falciparum
TNKSIDNFNFFLVRNEAELYDP

SEQ ID NO: 3404996 - protein, 17 aa, Plasmodium falciparum
TNLRNGYLNNTYFNEEN

SEQ ID NO: 3404997 - protein, 17 aa, Plasmodium falciparum
TNYFKAPVVIINYPTHI

SEQ ID NO: 3404998 - protein, 19 aa, Plasmodium falciparum
TPFGLLKFYELCKHLHISP

SEQ ID NO: 3404999 - protein, 26 aa, Plasmodium falciparum
TPTLKVKRFRVFKDYSFFIDEVKKIY

SEQ ID NO: 3405000 - protein, 24 aa, Plasmodium falciparum
TPTLKVKRFYVFKDYNFFIEEVKK

SEQ ID NO: 3405001 - protein, 17 aa, Plasmodium falciparum
TPVEHFVFTGQRRGINL

SEQ ID NO: 3405002 - protein, 26 aa, Plasmodium falciparum
TREVARKNLILALRKLHIDGDIKTGT

SEQ ID NO: 3405003 - protein, 24 aa, Plasmodium falciparum
TRIQRAFRPFSYVDLSNITCIYKN

SEQ ID NO: 3405004 - protein, 23 aa, Plasmodium falciparum
TSEILRKIFPCINEIIHKFEIIG

SEQ ID NO: 3405005 - protein, 24 aa, Plasmodium falciparum
TSGCNREPLGFESWRFVKYPYGNL

SEQ ID NO: 3405006 - protein, 17 aa, Plasmodium falciparum
TSLKSMRAVSLSSLQKL

SEQ ID NO: 3405007 - protein, 22 aa, Plasmodium falciparum
TSLLNKCFKIMKIVIPQTSGLN

SEQ ID NO: 3405008 - protein, 22 aa, Plasmodium falciparum
TSSDIKYATSFNATIIAFGVKL

SEQ ID NO: 3405009 - protein, 24 aa, Plasmodium falciparum
TSVFPGLYFIGIGYNLLFGNPLGE

SEQ ID NO: 3405010 - protein, 24 aa, Plasmodium falciparum
TTIPRLNILKKFKCFIKDIEELKM

SEQ ID NO: 3405011 - protein, 18 aa, Plasmodium falciparum
TTLNYPLYFNKKSITLKQ

SEQ ID NO: 3405012 - protein, 23 aa, Plasmodium falciparum
TTSQPRYNCINRYNVPKDYEENK

SEQ ID NO: 3405013 - protein, 19 aa, Plasmodium falciparum
TTYSCVGVFKNGRVEILNN

SEQ ID NO: 3405014 - protein, 25 aa, Plasmodium falciparum
TVILIPLTFCFKNALIKHSINIVSK

SEQ ID NO: 3405015 - protein, 19 aa, Plasmodium falciparum
TVKAAREIIKLGGKCLLLK

SEQ ID NO: 3405016 - protein, 18 aa, Plasmodium falciparum
TVMKELYDSYAYYGKKYD

SEQ ID NO: 3405017 - protein, 18 aa, Plasmodium falciparum
TYHCYKLGKQAAELLESI

SEQ ID NO: 3405018 - protein, 23 aa, Plasmodium falciparum
TYKLETFLFSWKYNFTKNKNIIE

SEQ ID NO: 3405019 - protein, 30 aa, Plasmodium falciparum
TYPANISVGMNFIWPINFVPLLSKQYTKRL

SEQ ID NO: 3405020 - protein, 25 aa, Plasmodium falciparum
VAKLYYNKRVNGFVHLYNGQEAVST

SEQ ID NO: 3405021 - protein, 26 aa, Plasmodium falciparum
VAYIKGDELIIKWKVIEEGNIPIDIK

SEQ ID NO: 3405022 - protein, 21 aa, Plasmodium falciparum
VAYIPPECWEIKKLHKTEKIR

SEQ ID NO: 3405023 - protein, 19 aa, Plasmodium falciparum
VCAHPLLHMPMKSKNETVK

SEQ ID NO: 3405024 - protein, 23 aa, Plasmodium falciparum
VCKEYINRCHIITSKVLINNAKV

SEQ ID NO: 3405025 - protein, 22 aa, Plasmodium falciparum
VCLGLKRNSRENIHHMNNEENE

SEQ ID NO: 3405026 - protein, 17 aa, Plasmodium falciparum
VCLSLKYNNNVFTPIFN

SEQ ID NO: 3405027 - protein, 18 aa, Plasmodium falciparum
VCVSLIFFFLKLSINAKK

SEQ ID NO: 3405028 - protein, 23 aa, Plasmodium falciparum
VDDWVKSRCGLLTSDDSYVVIKK

SEQ ID NO: 3405029 - protein, 25 aa, Plasmodium falciparum
VDIEKCLQCTLLVIKADKNDECLKY

SEQ ID NO: 3405030 - protein, 24 aa, Plasmodium falciparum
VDILKRTQLEWLCIDLDLVEGLLC

SEQ ID NO: 3405031 - protein, 25 aa, Plasmodium falciparum
VDLLHFYVFLPIYIKDIYEFNIVCD

SEQ ID NO: 3405032 - protein, 23 aa, Plasmodium falciparum
VDNTLRYGKVIIMTDADVDGEHI

SEQ ID NO: 3405033 - protein, 20 aa, Plasmodium falciparum
VDTQKCIRAGGKHNDLDDVG

SEQ ID NO: 3405034 - protein, 29 aa, Plasmodium falciparum
VEELKKGILDMGIKLLFSKVKSLLKKLKN

SEQ ID NO: 3405035 - protein, 26 aa, Plasmodium falciparum
VEEQGNCGLCWIFASKLHFETIRCMR

SEQ ID NO: 3405036 - protein, 22 aa, Plasmodium falciparum
VEKTASCGVWDEWSPCSVTCGK

SEQ ID NO: 3405037 - protein, 27 aa, Plasmodium falciparum
VELNVLCSGAPILIQQWKYYQNMLGFE

SEQ ID NO: 3405038 - protein, 24 aa, Plasmodium falciparum
VELPYSCRGGSCSTCAAKLVEGEV

SEQ ID NO: 3405039 - protein, 19 aa, Plasmodium falciparum
VESELKGAIDLLISSFYKS

SEQ ID NO: 3405040 - protein, 17 aa, Plasmodium falciparum
VEVRTFFTYNGLGGLLF

SEQ ID NO: 3405041 - protein, 21 aa, Plasmodium falciparum
VEYLQRKGILFFVSASNCSHP

SEQ ID NO: 3405042 - protein, 23 aa, Plasmodium falciparum
VFDGYRIYLGFDYKSFQDTHIIT

SEQ ID NO: 3405043 - protein, 17 aa, Plasmodium falciparum
VFLFIAVLFCILSPGNN

SEQ ID NO: 3405044 - protein, 21 aa, Plasmodium falciparum
VFLRKGNKPFEHFNSPNFENM

SEQ ID NO: 3405045 - protein, 21 aa, Plasmodium falciparum
VFPLLIYFNYVLHRTYGYIIG

SEQ ID NO: 3405046 - protein, 19 aa, Plasmodium falciparum
VFVFLYFLNCVGCNSKNNN

SEQ ID NO: 3405047 - protein, 18 aa, Plasmodium falciparum
VGLGSFHFYLYVNNQNED

SEQ ID NO: 3405048 - protein, 18 aa, Plasmodium falciparum
VGRLNELTKLYGNNPSSD

SEQ ID NO: 3405049 - protein, 19 aa, Plasmodium falciparum
VGTKFPFEYLQEITDEEER

SEQ ID NO: 3405050 - protein, 19 aa, Plasmodium falciparum
VHEHKRGKGKLYLFEKEEL

SEQ ID NO: 3405051 - protein, 18 aa, Plasmodium falciparum
VHFIAWNIPRHINLINNF

SEQ ID NO: 3405052 - protein, 17 aa, Plasmodium falciparum
VHPFNLLLLLSIDNEHP

SEQ ID NO: 3405053 - protein, 17 aa, Plasmodium falciparum
VICCLVYYVRCINVQIG

SEQ ID NO: 3405054 - protein, 21 aa, Plasmodium falciparum
VICSFLVFLVFSNVLCFRGNN

SEQ ID NO: 3405055 - protein, 21 aa, Plasmodium falciparum
VIHHYNFDKNFLFPSLNSGII

SEQ ID NO: 3405056 - protein, 23 aa, Plasmodium falciparum
VIHPRKIMLVLNLLYKQGNYKAL

SEQ ID NO: 3405057 - protein, 22 aa, Plasmodium falciparum
VINNLSICFRIYGGNNKGNLFL

SEQ ID NO: 3405058 - protein, 21 aa, Plasmodium falciparum
VIRDVIMYDYPFKELRRPSNL

SEQ ID NO: 3405059 - protein, 20 aa, Plasmodium falciparum
VISFFILLLFCKAYNTSSLL

SEQ ID NO: 3405060 - protein, 17 aa, Plasmodium falciparum
VISFLLFTKNNEIGSKL

SEQ ID NO: 3405061 - protein, 18 aa, Plasmodium falciparum
VIYNWKLGKDSLLKMLCM

SEQ ID NO: 3405062 - protein, 26 aa, Plasmodium falciparum
VKCYLKRKESSYIKCNFNLIDNYVKR

SEQ ID NO: 3405063 - protein, 19 aa, Plasmodium falciparum
VKENCSINYEEIRKYCYDH

SEQ ID NO: 3405064 - protein, 21 aa, Plasmodium falciparum
VKFRYPDIRKLMHSIDTTIIA

SEQ ID NO: 3405065 - protein, 17 aa, Plasmodium falciparum
VKILGAFTLIDEGELDW

SEQ ID NO: 3405066 - protein, 17 aa, Plasmodium falciparum
VKINTTFDSIKSKKNML

SEQ ID NO: 3405067 - protein, 17 aa, Plasmodium falciparum
VKITSWDKEDIIKENED

SEQ ID NO: 3405068 - protein, 22 aa, Plasmodium falciparum
VKNIFKEFLYYYINKKDPNYQL

SEQ ID NO: 3405069 - protein, 19 aa, Plasmodium falciparum
VKNKSCFLNTFGVSPIVTK

SEQ ID NO: 3405070 - protein, 20 aa, Plasmodium falciparum
VKNLFGNAIFQFNKYIYTFD

SEQ ID NO: 3405071 - protein, 17 aa, Plasmodium falciparum
VKQSCLNATLSYKFIAE

SEQ ID NO: 3405072 - protein, 18 aa, Plasmodium falciparum
VKRFSVIQDYAFFIDQVK

SEQ ID NO: 3405073 - protein, 19 aa, Plasmodium falciparum
VKVSWAYSPEFVKISVSSD

SEQ ID NO: 3405074 - protein, 18 aa, Plasmodium falciparum
VLAGYRLSAYLKDIIANI

SEQ ID NO: 3405075 - protein, 24 aa, Plasmodium falciparum
VLAGYRLTHYLKIIIQNVPTDLLN

SEQ ID NO: 3405076 - protein, 17 aa, Plasmodium falciparum
VLCIINVMAYCISLNKY

SEQ ID NO: 3405077 - protein, 18 aa, Plasmodium falciparum
VLEAKRKRKIFVNIIDIL

SEQ ID NO: 3405078 - protein, 25 aa, Plasmodium falciparum
VLINDCIKGYLLYDEKLNLSEQLHK

SEQ ID NO: 3405079 - protein, 17 aa, Plasmodium falciparum
VLISFFNKSRCDNELSV

SEQ ID NO: 3405080 - protein, 25 aa, Plasmodium falciparum
VLKQIPANISCCPINSIEQEKYNND

SEQ ID NO: 3405081 - protein, 20 aa, Plasmodium falciparum
VLKSCYNLIKSELEKLQGSL

SEQ ID NO: 3405082 - protein, 18 aa, Plasmodium falciparum
VLLLCTFLINFAKCKYII

SEQ ID NO: 3405083 - protein, 27 aa, Plasmodium falciparum
VLRHILKKLPFNYLIHMNWNDTYIHID

SEQ ID NO: 3405084 - protein, 34 aa, Plasmodium falciparum
VLSRGTGCLGVVFRAKDDFNFYLFDICDKDGTKR

SEQ ID NO: 3405085 - protein, 24 aa, Plasmodium falciparum
VLVPPRRTKLCLRNINKVWHRIKD

SEQ ID NO: 3405086 - protein, 25 aa, Plasmodium falciparum
VLYFPTFRLLFPVYDKINDKEYKYI

SEQ ID NO: 3405087 - protein, 25 aa, Plasmodium falciparum
VLYIKNNILILKWKVQDKDSKPTNI

SEQ ID NO: 3405088 - protein, 25 aa, Plasmodium falciparum
VNDGLKYLFIPSHNSFIKKYSVFNQ

SEQ ID NO: 3405089 - protein, 25 aa, Plasmodium falciparum
VNKYELLKKLILNFFKDNLKDHRAQ

SEQ ID NO: 3405090 - protein, 35 aa, Plasmodium falciparum
VNRSTWLNIAERIFKGNAPFNFTIIPYNYVNNSTE

SEQ ID NO: 3405091 - protein, 17 aa, Plasmodium falciparum
VNSKLIICKALDEHKLG

SEQ ID NO: 3405092 - protein, 25 aa, Plasmodium falciparum
VNSLKHKNCYTLNYNPFFFVHNDFK

SEQ ID NO: 3405093 - protein, 23 aa, Plasmodium falciparum
VPIDLRIDDYIKFSPFSNESCEF

SEQ ID NO: 3405094 - protein, 20 aa, Plasmodium falciparum
VPKYCQGGILSKKHKNNDSD

SEQ ID NO: 3405095 - protein, 18 aa, Plasmodium falciparum
VPLGSFFFPEMKRAPYQL

SEQ ID NO: 3405096 - protein, 19 aa, Plasmodium falciparum
VPTIDLFDKIRIEEDILNL

SEQ ID NO: 3405097 - protein, 29 aa, Plasmodium falciparum
VPWNKARSFFYYRLMRRLLINILSRKYDN

SEQ ID NO: 3405098 - protein, 23 aa, Plasmodium falciparum
VQKLCSCLFNFYYYDEIYECQPF

SEQ ID NO: 3405099 - protein, 25 aa, Plasmodium falciparum
VRIAWKALTNYALYECKNIFIKNLD

SEQ ID NO: 3405100 - protein, 17 aa, Plasmodium falciparum
VRKVDCLVNISELPESR

SEQ ID NO: 3405101 - protein, 23 aa, Plasmodium falciparum
VRNEMKLFFFGDHLIKNSEEIVL

SEQ ID NO: 3405102 - protein, 22 aa, Plasmodium falciparum
VRSDYNFMLSFLRTRKIFSHKK

SEQ ID NO: 3405103 - protein, 17 aa, Plasmodium falciparum
VSEELYDGFVMYNGTYV

SEQ ID NO: 3405104 - protein, 19 aa, Plasmodium falciparum
VSERVHVYHILKHIKDGKI

SEQ ID NO: 3405105 - protein, 24 aa, Plasmodium falciparum
VSEYEIMKNLLITFSKKIDENNQI

SEQ ID NO: 3405106 - protein, 26 aa, Plasmodium falciparum
VSFIRDITCICVYPLCDSIYIFHEKK

SEQ ID NO: 3405107 - protein, 20 aa, Plasmodium falciparum
VSISLALKGVYGNRIFTFDK

SEQ ID NO: 3405108 - protein, 19 aa, Plasmodium falciparum
VSSCSNCLDFQARRLNLKY

SEQ ID NO: 3405109 - protein, 18 aa, Plasmodium falciparum
VTFFFVLLHYISCNKPTR

SEQ ID NO: 3405110 - protein, 17 aa, Plasmodium falciparum
VTIPLIYKITKLLYFER

SEQ ID NO: 3405111 - protein, 18 aa, Plasmodium falciparum
VTMFSKDQLEDMVKNFGG

SEQ ID NO: 3405112 - protein, 18 aa, Plasmodium falciparum
VTSNIKFPSDNKGKIIRG

SEQ ID NO: 3405113 - protein, 22 aa, Plasmodium falciparum
VTWYAGKIDIFVKVEEGKNYKI

SEQ ID NO: 3405114 - protein, 23 aa, Plasmodium falciparum
VVLCPIIILFFFLNSVVLGNNNR

SEQ ID NO: 3405115 - protein, 21 aa, Plasmodium falciparum
VVLLWRQAWVSSKSHKCDFTK

SEQ ID NO: 3405116 - protein, 19 aa, Plasmodium falciparum
VWFDAHYVWEVKAADLSLS

SEQ ID NO: 3405117 - protein, 18 aa, Plasmodium falciparum
VYDKILSTMFKILTEMSF

SEQ ID NO: 3405118 - protein, 25 aa, Plasmodium falciparum
VYDLYDYILNWVFGPMKITETNVSE

SEQ ID NO: 3405119 - protein, 17 aa, Plasmodium falciparum
VYIHQHINTSFTKKITE

SEQ ID NO: 3405120 - protein, 20 aa, Plasmodium falciparum
VYNKGIFVGTGIKLNDSQTT

SEQ ID NO: 3405121 - protein, 24 aa, Plasmodium falciparum
VYTYCLGKAYGIACILASSGKKGY

SEQ ID NO: 3405122 - protein, 24 aa, Plasmodium falciparum
WAINIKRYINYNIKIKLKTFTNKI

SEQ ID NO: 3405123 - protein, 19 aa, Plasmodium falciparum
WCGHCYKFEPVYREVGKRL

SEQ ID NO: 3405124 - protein, 22 aa, Plasmodium falciparum
WDRVNHAIVLLGWGEEEINGKL

SEQ ID NO: 3405125 - protein, 17 aa, Plasmodium falciparum
WEISIPFHETITREQSP

SEQ ID NO: 3405126 - protein, 19 aa, Plasmodium falciparum
WELGKACLSKYLGHSNNYF

SEQ ID NO: 3405127 - protein, 21 aa, Plasmodium falciparum
WFRLLGIYGSNSINWLIVDMA

SEQ ID NO: 3405128 - protein, 17 aa, Plasmodium falciparum
WIIRNTWGKNWGYKGYL

SEQ ID NO: 3405129 - protein, 17 aa, Plasmodium falciparum
WKCEVEWPCISAPKLKI

SEQ ID NO: 3405130 - protein, 19 aa, Plasmodium falciparum
WKIKKCGYFFLSYKNGKNN

SEQ ID NO: 3405131 - protein, 18 aa, Plasmodium falciparum
WKSILSYRRLKDINNMDG

SEQ ID NO: 3405132 - protein, 21 aa, Plasmodium falciparum
WLDFRRRTLKKIDEMKKKAEL

SEQ ID NO: 3405133 - protein, 17 aa, Plasmodium falciparum
WLKIDFNNLRSYWKYEN

SEQ ID NO: 3405134 - protein, 20 aa, Plasmodium falciparum
WLPDIRIDDTLILIDNIEKS

SEQ ID NO: 3405135 - protein, 20 aa, Plasmodium falciparum
WNKKCTYCPNGMKEEKTIEL

SEQ ID NO: 3405136 - protein, 20 aa, Plasmodium falciparum
WNLLQKGAYIYVCGNSNMSK

SEQ ID NO: 3405137 - protein, 17 aa, Plasmodium falciparum
WPGWGHSSENPLLSTLL

SEQ ID NO: 3405138 - protein, 21 aa, Plasmodium falciparum
WPKAECTLFLLQNEVIKPLEI

SEQ ID NO: 3405139 - protein, 19 aa, Plasmodium falciparum
WRIHNAVTLRSMYDLLMID

SEQ ID NO: 3405140 - protein, 17 aa, Plasmodium falciparum
WRYKDKGNEYERKLKYT

SEQ ID NO: 3405141 - protein, 21 aa, Plasmodium falciparum
WSFLLCDIYETLNIRKSIDRK

SEQ ID NO: 3405142 - protein, 17 aa, Plasmodium falciparum
WTLSKDEINLFPPYIKK

SEQ ID NO: 3405143 - protein, 18 aa, Plasmodium falciparum
WTTLFWPKKLKRILRQLL

SEQ ID NO: 3405144 - protein, 17 aa, Plasmodium falciparum
WVSEPYLKIGRSHTLYT

SEQ ID NO: 3405145 - protein, 17 aa, Plasmodium falciparum
WYNLKLSYNGSNIKLIL

SEQ ID NO: 3405146 - protein, 19 aa, Plasmodium falciparum
WYNNFKLIETCFDKNNFIY

SEQ ID NO: 3405147 - protein, 19 aa, Plasmodium falciparum
WYYLCSVQFIWGDIKLVNS

SEQ ID NO: 3405148 - protein, 17 aa, Plasmodium falciparum
YAKGVLKNVEFKCENVD

SEQ ID NO: 3405149 - protein, 21 aa, Plasmodium falciparum
YATWCRVSRGFSNDFINIAKT

SEQ ID NO: 3405150 - protein, 24 aa, Plasmodium falciparum
YCGTEKLFIERYAPTNLFVQNRIF

SEQ ID NO: 3405151 - protein, 19 aa, Plasmodium falciparum
YCNIKSIMVTNNIIKFSIN

SEQ ID NO: 3405152 - protein, 23 aa, Plasmodium falciparum
YDEKCIKALIMAREVAKNDNENE

SEQ ID NO: 3405153 - protein, 19 aa, Plasmodium falciparum
YDFEVEFFILTFNRFTSKF

SEQ ID NO: 3405154 - protein, 18 aa, Plasmodium falciparum
YDFFLKKKNFILLTGKNM

SEQ ID NO: 3405155 - protein, 22 aa, Plasmodium falciparum
YDIIKKLLNSIFRDNNENEKMK

SEQ ID NO: 3405156 - protein, 32 aa, Plasmodium falciparum
YDNYNCINRGAIFREIIEICHFEKEDLANLFG

SEQ ID NO: 3405157 - protein, 18 aa, Plasmodium falciparum
YDPNKSKTFRRSFIEKNL

SEQ ID NO: 3405158 - protein, 18 aa, Plasmodium falciparum
YDTFEIINSVQLQQIGKW

SEQ ID NO: 3405159 - protein, 17 aa, Plasmodium falciparum
YDVFMVINITDIDDKII

SEQ ID NO: 3405160 - protein, 17 aa, Plasmodium falciparum
YDWDEGVHIFDNWLKKQ

SEQ ID NO: 3405161 - protein, 17 aa, Plasmodium falciparum
YDYITWVRDNTAVINNT

SEQ ID NO: 3405162 - protein, 17 aa, Plasmodium falciparum
YDYLCVFNNQNITSDKN

SEQ ID NO: 3405163 - protein, 37 aa, Plasmodium falciparum
YEDETKRTTKLCRHKFKLPIDFFKLGDQVRAKVVHVQ

SEQ ID NO: 3405164 - protein, 22 aa, Plasmodium falciparum
YEEIKWINGRLGFWDLSGNPLM

SEQ ID NO: 3405165 - protein, 20 aa, Plasmodium falciparum
YEHLKYPDINTIHIYYNASP

SEQ ID NO: 3405166 - protein, 17 aa, Plasmodium falciparum
YEIGCVKTAKRKIPSLY

SEQ ID NO: 3405167 - protein, 18 aa, Plasmodium falciparum
YEKHTYCLLLDKYKVNKI

SEQ ID NO: 3405168 - protein, 19 aa, Plasmodium falciparum
YELCKHLHISPPVSVQLEY

SEQ ID NO: 3405169 - protein, 17 aa, Plasmodium falciparum
YENWKLSPIDFGDMDDI

SEQ ID NO: 3405170 - protein, 17 aa, Plasmodium falciparum
YERNMMFPIHLGVTEAG

SEQ ID NO: 3405171 - protein, 17 aa, Plasmodium falciparum
YEVSQIFSYYKRKRKMI

SEQ ID NO: 3405172 - protein, 24 aa, Plasmodium falciparum
YEYKRISENLNRFFMESNSNAPQF

SEQ ID NO: 3405173 - protein, 19 aa, Plasmodium falciparum
YFESCIPSIGKVAYIPPEC

SEQ ID NO: 3405174 - protein, 19 aa, Plasmodium falciparum
YFFQIYEVHAFDFKLLHYI

SEQ ID NO: 3405175 - protein, 19 aa, Plasmodium falciparum
YFGIREVKLIGGGNPYFLL

SEQ ID NO: 3405176 - protein, 24 aa, Plasmodium falciparum
YFINREGYVVFDFIKREQPHQSCL

SEQ ID NO: 3405177 - protein, 18 aa, Plasmodium falciparum
YFSSTFLLLLVLQSKTKY

SEQ ID NO: 3405178 - protein, 18 aa, Plasmodium falciparum
YFYFLNSLYDRMRKISYK

SEQ ID NO: 3405179 - protein, 17 aa, Plasmodium falciparum
YGCRKRDILNLKIRLTL

SEQ ID NO: 3405180 - protein, 17 aa, Plasmodium falciparum
YGFLGFGVNHCKEKIFI

SEQ ID NO: 3405181 - protein, 19 aa, Plasmodium falciparum
YGKFFRKVLSFSHSLNNFE

SEQ ID NO: 3405182 - protein, 17 aa, Plasmodium falciparum
YGKVCPIGYKIINERTE

SEQ ID NO: 3405183 - protein, 17 aa, Plasmodium falciparum
YGLKKIGILPLWSNTFS

SEQ ID NO: 3405184 - protein, 19 aa, Plasmodium falciparum
YHGRIRKMYVSFKRKGCQC

SEQ ID NO: 3405185 - protein, 35 aa, Plasmodium falciparum
YHSRYKNLLMYGIDFNFHVSYFLKGDIQYLPLSYY

SEQ ID NO: 3405186 - protein, 24 aa, Plasmodium falciparum
YIACPSCGRTLFNIQETTKKIMKL

SEQ ID NO: 3405187 - protein, 23 aa, Plasmodium falciparum
YIDDIRTSFIWAYKKKLNDLNIL

SEQ ID NO: 3405188 - protein, 25 aa, Plasmodium falciparum
YIDIGCKTLAFLNLGHYNKDPNNFL

SEQ ID NO: 3405189 - protein, 17 aa, Plasmodium falciparum
YIFKHFEDLVTRKIYEL

SEQ ID NO: 3405190 - protein, 25 aa, Plasmodium falciparum
YIFKLSEFYSKNVLEVSVYVNEIIN

SEQ ID NO: 3405191 - protein, 24 aa, Plasmodium falciparum
YIFLNIKFSHRWSSPGALKVKDEE

SEQ ID NO: 3405192 - protein, 22 aa, Plasmodium falciparum
YIGDKTSKCLLKEYHNIENILK

SEQ ID NO: 3405193 - protein, 17 aa, Plasmodium falciparum
YIITYIFNLIKNKVNIN

SEQ ID NO: 3405194 - protein, 23 aa, Plasmodium falciparum
YIKHEFKNLIFLYKNNVNIMQMV

SEQ ID NO: 3405195 - protein, 21 aa, Plasmodium falciparum
YIKKLDIYIDYIFQPYTIYNI

SEQ ID NO: 3405196 - protein, 21 aa, Plasmodium falciparum
YILLCTCYPKSDCVIETHKED

SEQ ID NO: 3405197 - protein, 25 aa, Plasmodium falciparum
YILMFKVAYLFNNYDFYTFFYDLTG

SEQ ID NO: 3405198 - protein, 22 aa, Plasmodium falciparum
YIMFINNCRIIFIASDEKVEIQ

SEQ ID NO: 3405199 - protein, 26 aa, Plasmodium falciparum
YINFTWRKLYLGIAWFIHTRGHPIVI

SEQ ID NO: 3405200 - protein, 22 aa, Plasmodium falciparum
YINIPFSRSIFKSNTIDLSLVH

SEQ ID NO: 3405201 - protein, 19 aa, Plasmodium falciparum
YINKDVILLGLDFLLNKKL

SEQ ID NO: 3405202 - protein, 18 aa, Plasmodium falciparum
YISYRFLPDKAIDLIDEA

SEQ ID NO: 3405203 - protein, 25 aa, Plasmodium falciparum
YITTCDYKRAYSIYNSLKIKGKVDN

SEQ ID NO: 3405204 - protein, 19 aa, Plasmodium falciparum
YIYLFFVFLPFSFCYIRNN

SEQ ID NO: 3405205 - protein, 26 aa, Plasmodium falciparum
YIYTCSDIILPYLLSFNMHENNKTTY

SEQ ID NO: 3405206 - protein, 23 aa, Plasmodium falciparum
YKADSKYLYKQFENVNEVNLQLL

SEQ ID NO: 3405207 - protein, 26 aa, Plasmodium falciparum
YKDILVFKWKVYEEGLSKEQDVDEMK

SEQ ID NO: 3405208 - protein, 20 aa, Plasmodium falciparum
YKDNLKFSVYENGKIINEYV

SEQ ID NO: 3405209 - protein, 31 aa, Plasmodium falciparum
YKELNLLFPDVCKIGKKIALCYEQIKKYIVC

SEQ ID NO: 3405210 - protein, 17 aa, Plasmodium falciparum
YKEYRKFLKSGCYEDDI

SEQ ID NO: 3405211 - protein, 17 aa, Plasmodium falciparum
YKHLMKIFLDKYKLDNN

SEQ ID NO: 3405212 - protein, 18 aa, Plasmodium falciparum
YKKIEEYGSITFIHDILL

SEQ ID NO: 3405213 - protein, 25 aa, Plasmodium falciparum
YKKNNCKKYFLNSHYNNYLCKKQKK

SEQ ID NO: 3405214 - protein, 17 aa, Plasmodium falciparum
YKLCSISSDMLIISTPR

SEQ ID NO: 3405215 - protein, 17 aa, Plasmodium falciparum
YKNAHDFIFEDIPKEHY

SEQ ID NO: 3405216 - protein, 26 aa, Plasmodium falciparum
YKNEELKDEFKIFCKKKEKPKYTPPQ

SEQ ID NO: 3405217 - protein, 26 aa, Plasmodium falciparum
YKNFDFKEIFSFLNYDDIGATFLNYL

SEQ ID NO: 3405218 - protein, 21 aa, Plasmodium falciparum
YKPIMKLLLKKYRLRNNKIAI

SEQ ID NO: 3405219 - protein, 23 aa, Plasmodium falciparum
YKRRKKKMLEFRVKNHKDNDIDP

SEQ ID NO: 3405220 - protein, 17 aa, Plasmodium falciparum
YKSNYILTIPRGSKTFK

SEQ ID NO: 3405221 - protein, 20 aa, Plasmodium falciparum
YKTHLLHISLTWNEKQWEHW

SEQ ID NO: 3405222 - protein, 17 aa, Plasmodium falciparum
YKYDWDEGVHIFDNWLK

SEQ ID NO: 3405223 - protein, 18 aa, Plasmodium falciparum
YLCPLPEFLIDVMRTTKY

SEQ ID NO: 3405224 - protein, 18 aa, Plasmodium falciparum
YLLPNFDDPVIWRGPKKN

SEQ ID NO: 3405225 - protein, 21 aa, Plasmodium falciparum
YLNFCACMWPWTKKWKAENQM

SEQ ID NO: 3405226 - protein, 22 aa, Plasmodium falciparum
YLTINFFILLTLVFQKYSSCQN

SEQ ID NO: 3405227 - protein, 24 aa, Plasmodium falciparum
YLTNCSKGKISKRCTEGGNPSEFL

SEQ ID NO: 3405228 - protein, 24 aa, Plasmodium falciparum
YLTSRMIYLPAIINYQTNYITFYS

SEQ ID NO: 3405229 - protein, 17 aa, Plasmodium falciparum
YLVCLKFGHVLNNGIVK

SEQ ID NO: 3405230 - protein, 19 aa, Plasmodium falciparum
YLYNLKEFENILNLLNINA

SEQ ID NO: 3405231 - protein, 17 aa, Plasmodium falciparum
YLYSTIYEKVCYTPLQK

SEQ ID NO: 3405232 - protein, 20 aa, Plasmodium falciparum
YMFNNLRISNNLNNDKNSNV

SEQ ID NO: 3405233 - protein, 17 aa, Plasmodium falciparum
YMKRLRGSIATYIIREL

SEQ ID NO: 3405234 - protein, 18 aa, Plasmodium falciparum
YMVKFLLHDFQEWSFEKD

SEQ ID NO: 3405235 - protein, 18 aa, Plasmodium falciparum
YNASYAYFTLMNMIGKNH

SEQ ID NO: 3405236 - protein, 18 aa, Plasmodium falciparum
YNCGVKYCNKELIRCTGL

SEQ ID NO: 3405237 - protein, 24 aa, Plasmodium falciparum
YNDLRICMNSSYILPEKKNKKKNE

SEQ ID NO: 3405238 - protein, 17 aa, Plasmodium falciparum
YNFKRSLLLKLGHQQTV

SEQ ID NO: 3405239 - protein, 23 aa, Plasmodium falciparum
YNFLKGEWAYLDYKRDSRRACGK

SEQ ID NO: 3405240 - protein, 18 aa, Plasmodium falciparum
YNGTYCLYPENVIENDII

SEQ ID NO: 3405241 - protein, 27 aa, Plasmodium falciparum
YNKQLKYKINFCRNLYFNNKNEYNRIC

SEQ ID NO: 3405242 - protein, 32 aa, Plasmodium falciparum
YNKTEIRNLCKFLSVIKKPIISWREQHGYILG

SEQ ID NO: 3405243 - protein, 23 aa, Plasmodium falciparum
YNLFLPTYIAIIFDSKTSNNDKK

SEQ ID NO: 3405244 - protein, 23 aa, Plasmodium falciparum
YNNKLKGCAPISVNSENKDEEKK

SEQ ID NO: 3405245 - protein, 25 aa, Plasmodium falciparum
YNNVGRKRVLSFNINNVYSRILSDL

SEQ ID NO: 3405246 - protein, 18 aa, Plasmodium falciparum
YNQLKAKELNFVRITKEL

SEQ ID NO: 3405247 - protein, 17 aa, Plasmodium falciparum
YNVPNGRILRLDTPEPW

SEQ ID NO: 3405248 - protein, 17 aa, Plasmodium falciparum
YNYFPKYTHEFYHNFYD

SEQ ID NO: 3405249 - protein, 17 aa, Plasmodium falciparum
YNYYKKDGVCLIQNPCL

SEQ ID NO: 3405250 - protein, 24 aa, Plasmodium falciparum
YPDYSMPCPLHFFRTSTGCVPLRT

SEQ ID NO: 3405251 - protein, 17 aa, Plasmodium falciparum
YPFYFSFLNMNKINNNK

SEQ ID NO: 3405252 - protein, 24 aa, Plasmodium falciparum
YPHTLSLLLEWFRSYKMADTKKLN

SEQ ID NO: 3405253 - protein, 19 aa, Plasmodium falciparum
YPKEINLLPKKVGNLIGLR

SEQ ID NO: 3405254 - protein, 23 aa, Plasmodium falciparum
YPLYLKNLCGIIVNFKYSSPLFK

SEQ ID NO: 3405255 - protein, 19 aa, Plasmodium falciparum
YREKCPLNWKINKDNKLYC

SEQ ID NO: 3405256 - protein, 25 aa, Plasmodium falciparum
YREVGKRLNLYAAKFKNYKNDIIIS

SEQ ID NO: 3405257 - protein, 19 aa, Plasmodium falciparum
YRFLPDKAIDLIDEAASNL

SEQ ID NO: 3405258 - protein, 17 aa, Plasmodium falciparum
YRKEKRENIFIGNKMKH

SEQ ID NO: 3405259 - protein, 20 aa, Plasmodium falciparum
YRKFLKSGCYEDDINRNKIA

SEQ ID NO: 3405260 - protein, 20 aa, Plasmodium falciparum
YRSLKKCRYLSEIIIENVTS

SEQ ID NO: 3405261 - protein, 24 aa, Plasmodium falciparum
YRTFSYKKDLDVLFKNWVLNEKKQ

SEQ ID NO: 3405262 - protein, 24 aa, Plasmodium falciparum
YRTIRPKLLYLILHLNKHFHDTLL

SEQ ID NO: 3405263 - protein, 20 aa, Plasmodium falciparum
YRYIKYKEYDVMICGGTEAS

SEQ ID NO: 3405264 - protein, 25 aa, Plasmodium falciparum
YSIKKGIKRNASFYHILYYLNKNKK

SEQ ID NO: 3405265 - protein, 24 aa, Plasmodium falciparum
YSITLSRWDKLIIKYPTNEKTHFE

SEQ ID NO: 3405266 - protein, 17 aa, Plasmodium falciparum
YSLACNVDFPFKDKQDC

SEQ ID NO: 3405267 - protein, 17 aa, Plasmodium falciparum
YSLRSNLLPALSPMKGL

SEQ ID NO: 3405268 - protein, 17 aa, Plasmodium falciparum
YSLYFLKDKIKNDTDQC

SEQ ID NO: 3405269 - protein, 20 aa, Plasmodium falciparum
YSSIFRLLVDTYKNIKENED

SEQ ID NO: 3405270 - protein, 19 aa, Plasmodium falciparum
YTGSLLLSIMLSELGDHAH

SEQ ID NO: 3405271 - protein, 18 aa, Plasmodium falciparum
YTPNFLYNLFFNNYTTND

SEQ ID NO: 3405272 - protein, 25 aa, Plasmodium falciparum
YTQEFYGVTGIFAWTYEDALILNTK

SEQ ID NO: 3405273 - protein, 24 aa, Plasmodium falciparum
YTYECLGAYAYLMNKFNILVNDSL

SEQ ID NO: 3405274 - protein, 24 aa, Plasmodium falciparum
YVHMFRILFELYAQYNKISNEKML

SEQ ID NO: 3405275 - protein, 26 aa, Plasmodium falciparum
YVIRRIIRRAIRFGKQVFNIKSNVLW

SEQ ID NO: 3405276 - protein, 25 aa, Plasmodium falciparum
YVKFFANKSYLLWRGIEQNKEIFNF

SEQ ID NO: 3405277 - protein, 26 aa, Plasmodium falciparum
YVNEYFLRNYVVIFIYGNIIISDLKG

SEQ ID NO: 3405278 - protein, 23 aa, Plasmodium falciparum
YVRKRIYKSIPIFHIGNVVRHKY

SEQ ID NO: 3405279 - protein, 23 aa, Plasmodium falciparum
YVSCYRVSFNLNKLKYVTESLKK

SEQ ID NO: 3405280 - protein, 29 aa, Plasmodium falciparum
YVTGRSVGIGAYLVRLGKRTIQKKGSSLL

SEQ ID NO: 3405281 - protein, 23 aa, Plasmodium falciparum
YYDFIKYTLNIFGLHIERQEDDN

SEQ ID NO: 3405282 - protein, 19 aa, Plasmodium falciparum
YYINRIMNYYFHIHDDYFT

SEQ ID NO: 3405283 - protein, 19 aa, Plasmodium falciparum
YYMALEFYSNLSYSNYNPY

SEQ ID NO: 3405284 - protein, 19 aa, Plasmodium falciparum
YYPGIAPKLYKVLIEPDNI

SEQ ID NO: 3405285 - protein, 17 aa, Plasmodium falciparum
YYPRKGSHFHIYSVVDN

SEQ ID NO: 3405286 - protein, 22 aa, Plasmodium falciparum
YYRITKKLILEWHEADKNSTKI

SEQ ID NO: 3405287 - protein, 22 aa, Plasmodium falciparum
YYSSCFKNVIVYNAIISGIHEK

SEQ ID NO: 3405288 - protein, 17 aa, Plasmodium falciparum
YYVNYGILMNLTKKGKK

SEQ ID NO: 3405289 - protein, 19 aa, Plasmodium falciparum
KNCALSWAFASKYHLETIK

SEQ ID NO: 3405290 - protein, 17 aa, Plasmodium falciparum
YSPSFATFRVWKNNTRR

SEQ ID NO: 3405291 - protein, 19 aa, Plasmodium falciparum
CFICLFFLCILKGVYNVKT

SEQ ID NO: 3405292 - protein, 19 aa, Plasmodium falciparum
CGLCCYLYSYCYNGRFFKN

SEQ ID NO: 3405293 - protein, 22 aa, Plasmodium falciparum
CLLASVCTLCICRNRELFPHIS

SEQ ID NO: 3405294 - protein, 24 aa, Plasmodium falciparum
CRHKFKLPIDFFKLGDQVRAKVVH

SEQ ID NO: 3405295 - protein, 22 aa, Plasmodium falciparum
DLLLRLLYKAYVSYKKRKAQEK

SEQ ID NO: 3405296 - protein, 17 aa, Plasmodium falciparum
DTCLLCVPSSYITNNCF

SEQ ID NO: 3405297 - protein, 19 aa, Plasmodium falciparum
DVKRVPCFDPNLADITIEQ

SEQ ID NO: 3405298 - protein, 18 aa, Plasmodium falciparum
ECFGELKGSIGKKQNVEL

SEQ ID NO: 3405299 - protein, 19 aa, Plasmodium falciparum
EKHECIIFPFIKKVDEINM

SEQ ID NO: 3405300 - protein, 17 aa, Plasmodium falciparum
EKRILHISGVFKEFYVD

SEQ ID NO: 3405301 - protein, 24 aa, Plasmodium falciparum
EKYVCFFCSTSLFIHNKIRSFINW

SEQ ID NO: 3405302 - protein, 19 aa, Plasmodium falciparum
ELLPLKFLKFHGSTNIDQV

SEQ ID NO: 3405303 - protein, 17 aa, Plasmodium falciparum
ENIFPDYFFLDIFTENK

SEQ ID NO: 3405304 - protein, 20 aa, Plasmodium falciparum
EYEVMIGYFTKYVRNVYAKT

SEQ ID NO: 3405305 - protein, 17 aa, Plasmodium falciparum
FCIPNMIMPIDVLSEKD

SEQ ID NO: 3405306 - protein, 18 aa, Plasmodium falciparum
FCKECCLYHTQLLDSNEK

SEQ ID NO: 3405307 - protein, 17 aa, Plasmodium falciparum
FFFCFYFEISFCENDKK

SEQ ID NO: 3405308 - protein, 26 aa, Plasmodium falciparum
FFLFWNFSTEFWKRFQYIHNNDIHNI

SEQ ID NO: 3405309 - protein, 26 aa, Plasmodium falciparum
FFSFVCLFFRVLSCEGIHEKKKINLK

SEQ ID NO: 3405310 - protein, 19 aa, Plasmodium falciparum
FKLKMGDLITSNFESTVVH

SEQ ID NO: 3405311 - protein, 19 aa, Plasmodium falciparum
FKNLHVWKTDLFCQNINYM

SEQ ID NO: 3405312 - protein, 24 aa, Plasmodium falciparum
FLFDLRFIYKTGFFTKRKTIINSY

SEQ ID NO: 3405313 - protein, 22 aa, Plasmodium falciparum
FLFPVFCFFQCYGIYKNKKISK

SEQ ID NO: 3405314 - protein, 24 aa, Plasmodium falciparum
FNIKSNVLWFYKLVDSVCFILGNT

SEQ ID NO: 3405315 - protein, 20 aa, Plasmodium falciparum
FNSLCPMGWNIVDIKNHICQ

SEQ ID NO: 3405316 - protein, 17 aa, Plasmodium falciparum
FQRHELFDKIIKKTKYI

SEQ ID NO: 3405317 - protein, 17 aa, Plasmodium falciparum
FRYTWTNIFDVFTLLPK

SEQ ID NO: 3405318 - protein, 17 aa, Plasmodium falciparum
FTLLPKWCQAFYLPQTL

SEQ ID NO: 3405319 - protein, 18 aa, Plasmodium falciparum
GDMFKCLDYCISRNAHMI

SEQ ID NO: 3405320 - protein, 20 aa, Plasmodium falciparum
GEIEFKCLIYIPSKAPSMND

SEQ ID NO: 3405321 - protein, 19 aa, Plasmodium falciparum
GICPWGNYFSCMEKYVKEH

SEQ ID NO: 3405322 - protein, 17 aa, Plasmodium falciparum
GKFIPINAFITLENKIN

SEQ ID NO: 3405323 - protein, 19 aa, Plasmodium falciparum
GKMVLQYLVHLKFLTQEKK

SEQ ID NO: 3405324 - protein, 17 aa, Plasmodium falciparum
GNCGLCWIFASKLHFET

SEQ ID NO: 3405325 - protein, 17 aa, Plasmodium falciparum
GYIIKIFLENNISSENI

SEQ ID NO: 3405326 - protein, 18 aa, Plasmodium falciparum
GYRFLRKVNFLFFKGKKN

SEQ ID NO: 3405327 - protein, 18 aa, Plasmodium falciparum
HGKGKIPFRRNFDETKED

SEQ ID NO: 3405328 - protein, 21 aa, Plasmodium falciparum
HIKCIKNFCKECCLYHTQLLD

SEQ ID NO: 3405329 - protein, 17 aa, Plasmodium falciparum
HNWKITNEFGIQRIHFN

SEQ ID NO: 3405330 - protein, 17 aa, Plasmodium falciparum
HSFCPYNWILINEEEHI

SEQ ID NO: 3405331 - protein, 17 aa, Plasmodium falciparum
HSFRYTWTNIFDVFTLL

SEQ ID NO: 3405332 - protein, 18 aa, Plasmodium falciparum
HYFAWEIGGGAPTYKPEN

SEQ ID NO: 3405333 - protein, 22 aa, Plasmodium falciparum
ICIFFIPYFCRASFKEYLSNKK

SEQ ID NO: 3405334 - protein, 19 aa, Plasmodium falciparum
ICLCSLILIRTYSALSLKG

SEQ ID NO: 3405335 - protein, 17 aa, Plasmodium falciparum
IEKCLQCTLLVIKADKN

SEQ ID NO: 3405336 - protein, 17 aa, Plasmodium falciparum
IEKCYQCSLLVENDSKS

SEQ ID NO: 3405337 - protein, 17 aa, Plasmodium falciparum
IFLKRIFNLILREKIIT

SEQ ID NO: 3405338 - protein, 20 aa, Plasmodium falciparum
IFLLCLRYGYSIKKKRSPNN

SEQ ID NO: 3405339 - protein, 19 aa, Plasmodium falciparum
IKMRLGHYIKILDDAIDQK

SEQ ID NO: 3405340 - protein, 18 aa, Plasmodium falciparum
IKSKGIKIFLCVCPNCSK

SEQ ID NO: 3405341 - protein, 19 aa, Plasmodium falciparum
ILIGLCIKLGYKRFMIYSE

SEQ ID NO: 3405342 - protein, 18 aa, Plasmodium falciparum
IMNECFKRRGIFIKKEIM

SEQ ID NO: 3405343 - protein, 17 aa, Plasmodium falciparum
INCNVSWPCSKICIEDF

SEQ ID NO: 3405344 - protein, 18 aa, Plasmodium falciparum
IRILLLTFLYRFQKEIIE

SEQ ID NO: 3405345 - protein, 24 aa, Plasmodium falciparum
ITEFLRYSIGYQRKWIYKFVLFYI

SEQ ID NO: 3405346 - protein, 22 aa, Plasmodium falciparum
IVYCFISSFYLIKSSSNDKNKI

SEQ ID NO: 3405347 - protein, 20 aa, Plasmodium falciparum
KCKNKVCVLCCKKHDPTTSK

SEQ ID NO: 3405348 - protein, 17 aa, Plasmodium falciparum
KCLQCTLLVIKADKNDE

SEQ ID NO: 3405349 - protein, 23 aa, Plasmodium falciparum
KCNCCFYSIPLIHIYHPNGSMHC

SEQ ID NO: 3405350 - protein, 29 aa, Plasmodium falciparum
KDIKIKMLRKLGVSYSRLPPIIKHTEGKC

SEQ ID NO: 3405351 - protein, 17 aa, Plasmodium falciparum
KDIPPIISYYIYNKNKN

SEQ ID NO: 3405352 - protein, 23 aa, Plasmodium falciparum
KDKFKELLCLNVNRSDPNRQYKL

SEQ ID NO: 3405353 - protein, 18 aa, Plasmodium falciparum
KDMKVCLEYAKYNRIYMM

SEQ ID NO: 3405354 - protein, 26 aa, Plasmodium falciparum
KELAQRMAIMFTKWLAPDEYGAVVDY

SEQ ID NO: 3405355 - protein, 22 aa, Plasmodium falciparum
KFKRQRAFNILKQWRAKEKKLK

SEQ ID NO: 3405356 - protein, 27 aa, Plasmodium falciparum
KIFLCVCPNCSKHFYLLIKKGSQKKMI

SEQ ID NO: 3405357 - protein, 17 aa, Plasmodium falciparum
KIFRNIIVLSRHILFLL

SEQ ID NO: 3405358 - protein, 19 aa, Plasmodium falciparum
KIIYCYNFKRELYIYYNRL

SEQ ID NO: 3405359 - protein, 20 aa, Plasmodium falciparum
KIKRFNVFKDFSFYIDAVKK

SEQ ID NO: 3405360 - protein, 17 aa, Plasmodium falciparum
KIYFLPLIFLKNNNKDV

SEQ ID NO: 3405361 - protein, 23 aa, Plasmodium falciparum
KLFVFPLCFIKVYPFIFKNKVAF

SEQ ID NO: 3405362 - protein, 20 aa, Plasmodium falciparum
KMDLCISISFGEIFNCNFFK

SEQ ID NO: 3405363 - protein, 20 aa, Plasmodium falciparum
KNCALSWAFASIYHLETIKC

SEQ ID NO: 3405364 - protein, 23 aa, Plasmodium falciparum
KNESICVLSFLYLIGINDDNGKL

SEQ ID NO: 3405365 - protein, 22 aa, Plasmodium falciparum
KNKCKIPLYWIKKLDNLKNMNA

SEQ ID NO: 3405366 - protein, 21 aa, Plasmodium falciparum
KNKLRFVSPYVYTYKLFSKKR

SEQ ID NO: 3405367 - protein, 17 aa, Plasmodium falciparum
KNLILALRKLHIDGDIK

SEQ ID NO: 3405368 - protein, 23 aa, Plasmodium falciparum
KQLKYKINFCRNLYFNNKNEYNR

SEQ ID NO: 3405369 - protein, 17 aa, Plasmodium falciparum
KRIGFPVMIKASQGGGG

SEQ ID NO: 3405370 - protein, 17 aa, Plasmodium falciparum
KSNCWLPCLFGSPCSDR

SEQ ID NO: 3405371 - protein, 20 aa, Plasmodium falciparum
KVKRFRVFKDYSFFIDEVKK

SEQ ID NO: 3405372 - protein, 19 aa, Plasmodium falciparum
KVLRWSRMWWVLLVREIVG

SEQ ID NO: 3405373 - protein, 21 aa, Plasmodium falciparum
KYKSFCFYFIRLVDSISGLFC

SEQ ID NO: 3405374 - protein, 17 aa, Plasmodium falciparum
LARKLQLTWGIYPHLSK

SEQ ID NO: 3405375 - protein, 20 aa, Plasmodium falciparum
LCLFFIYLYIYKTYGKVKNT

SEQ ID NO: 3405376 - protein, 19 aa, Plasmodium falciparum
LCSGAPILIQQWKYYQNML

SEQ ID NO: 3405377 - protein, 20 aa, Plasmodium falciparum
LEEFKWDGIIGLGFQNGDSI

SEQ ID NO: 3405378 - protein, 19 aa, Plasmodium falciparum
LEFKKRINIGIIYNTNYSV

SEQ ID NO: 3405379 - protein, 17 aa, Plasmodium falciparum
LEMKRFLLVHGGEPVNY

SEQ ID NO: 3405380 - protein, 20 aa, Plasmodium falciparum
LFEIPPLIIFLRFFFHEKNE

SEQ ID NO: 3405381 - protein, 18 aa, Plasmodium falciparum
LFICFFVFFVHAVSSQEQ

SEQ ID NO: 3405382 - protein, 20 aa, Plasmodium falciparum
LFVLCCLKLKHVNFLKWEQE

SEQ ID NO: 3405383 - protein, 20 aa, Plasmodium falciparum
LGGLYLNFFLSRVVSKKWKQ

SEQ ID NO: 3405384 - protein, 18 aa, Plasmodium falciparum
LHFLKTVYLFDIFLNEQS

SEQ ID NO: 3405385 - protein, 23 aa, Plasmodium falciparum
LITKVCDSYCFIKVLKNGSTGYL

SEQ ID NO: 3405386 - protein, 18 aa, Plasmodium falciparum
LKKEGWRDQIYLYWSSKI

SEQ ID NO: 3405387 - protein, 20 aa, Plasmodium falciparum
LKKGWSLPICKHLHLSYENM

SEQ ID NO: 3405388 - protein, 23 aa, Plasmodium falciparum
LKYGGSFDTIFSGFVNLLTPSSP

SEQ ID NO: 3405389 - protein, 18 aa, Plasmodium falciparum
LLCFICVIFLLHKNVVRS

SEQ ID NO: 3405390 - protein, 21 aa, Plasmodium falciparum
LLKYYLSALISFVPFIKPAMK

SEQ ID NO: 3405391 - protein, 22 aa, Plasmodium falciparum
LPPFKRWLVKRIISMRKANNNG

SEQ ID NO: 3405392 - protein, 22 aa, Plasmodium falciparum
LQKEIFYRLSLVIYNLNKKDKI

SEQ ID NO: 3405393 - protein, 19 aa, Plasmodium falciparum
LRGLFPFRPWIDVITKSDL

SEQ ID NO: 3405394 - protein, 18 aa, Plasmodium falciparum
LSVGIAFAALSSFLLKKK

SEQ ID NO: 3405395 - protein, 24 aa, Plasmodium falciparum
MDEIKHLFPVIGEKLLNMNGQDGN

SEQ ID NO: 3405396 - protein, 17 aa, Plasmodium falciparum
MHKYCLQNNLLSKVDMY

SEQ ID NO: 3405397 - protein, 19 aa, Plasmodium falciparum
MKFAWASSCDVIFTDRFNS

SEQ ID NO: 3405398 - protein, 17 aa, Plasmodium falciparum
NENKCFCQFTDQPEGEH

SEQ ID NO: 3405399 - protein, 25 aa, Plasmodium falciparum
NGSTTYCYMRYTFNFNLEKLNENSR

SEQ ID NO: 3405400 - protein, 19 aa, Plasmodium falciparum
NIAERIFKGNAPFNFTIIP

SEQ ID NO: 3405401 - protein, 18 aa, Plasmodium falciparum
NICILFFVVCTLNFSTKC

SEQ ID NO: 3405402 - protein, 20 aa, Plasmodium falciparum
NIEKCFQCALLVEKENKNDV

SEQ ID NO: 3405403 - protein, 26 aa, Plasmodium falciparum
NIINEYPLREWILVTFHYIKGMITLQ

SEQ ID NO: 3405404 - protein, 18 aa, Plasmodium falciparum
NILKICLNKSISFITKRY

SEQ ID NO: 3405405 - protein, 17 aa, Plasmodium falciparum
NKCIFNWDIGKETLLKM

SEQ ID NO: 3405406 - protein, 17 aa, Plasmodium falciparum
NKMMYFQRHELFDKIIK

SEQ ID NO: 3405407 - protein, 18 aa, Plasmodium falciparum
NKTCFKSLGGKNCNNGNF

SEQ ID NO: 3405408 - protein, 19 aa, Plasmodium falciparum
NPAALHFLSFIYFYDFHKI

SEQ ID NO: 3405409 - protein, 21 aa, Plasmodium falciparum
PDYCYDLKSSICASAIDSYFL

SEQ ID NO: 3405410 - protein, 18 aa, Plasmodium falciparum
PIDMWLKQFEMMDTYNGE

SEQ ID NO: 3405411 - protein, 24 aa, Plasmodium falciparum
PISAELRGGSWVVVDETLNSQIIE

SEQ ID NO: 3405412 - protein, 17 aa, Plasmodium falciparum
PLTFCFKNALIKHSINI

SEQ ID NO: 3405413 - protein, 23 aa, Plasmodium falciparum
PYLERFKKIHLWLDFDKAGKSSV

SEQ ID NO: 3405414 - protein, 19 aa, Plasmodium falciparum
QAVVISWDYSCFAPNEWKK

SEQ ID NO: 3405415 - protein, 17 aa, Plasmodium falciparum
QKCYLAWSFNSLNINDE

SEQ ID NO: 3405416 - protein, 17 aa, Plasmodium falciparum
RAQIYLMEWALSKEGIA

SEQ ID NO: 3405417 - protein, 17 aa, Plasmodium falciparum
RDSNLYLYEWLQHLNKA

SEQ ID NO: 3405418 - protein, 21 aa, Plasmodium falciparum
RELKLKFEAMSRIKEYKIYNE

SEQ ID NO: 3405419 - protein, 18 aa, Plasmodium falciparum
RILHISGVFKEFYVDVDN

SEQ ID NO: 3405420 - protein, 17 aa, Plasmodium falciparum
RRFNVFKDFSFFIDEVK

SEQ ID NO: 3405421 - protein, 17 aa, Plasmodium falciparum
RRFNVFKDFSFYIDQVK

SEQ ID NO: 3405422 - protein, 19 aa, Plasmodium falciparum
SAFIKRQWVPNNYIYFKTD

SEQ ID NO: 3405423 - protein, 23 aa, Plasmodium falciparum
SESLEFFKNIFLFYPPFEVTKHI

SEQ ID NO: 3405424 - protein, 19 aa, Plasmodium falciparum
SFFLFCMVHFVFCDKNTFP

SEQ ID NO: 3405425 - protein, 18 aa, Plasmodium falciparum
SFFYYRLMRRLLINILSR

SEQ ID NO: 3405426 - protein, 18 aa, Plasmodium falciparum
SKDILKEYTILFFHSYNV

SEQ ID NO: 3405427 - protein, 18 aa, Plasmodium falciparum
SLYLEYFSFLALDMHANI

SEQ ID NO: 3405428 - protein, 18 aa, Plasmodium falciparum
SNDPLIFSVGWRRYQSIP

SEQ ID NO: 3405429 - protein, 19 aa, Plasmodium falciparum
SSAYPMEWLPVIYRDVFEQ

SEQ ID NO: 3405430 - protein, 24 aa, Plasmodium falciparum
SSIRLTKMIKYRGAGTIEYLYDQI

SEQ ID NO: 3405431 - protein, 21 aa, Plasmodium falciparum
STICFPEYTFSYIFDTRLLRV

SEQ ID NO: 3405432 - protein, 20 aa, Plasmodium falciparum
SYAEIIFCIRIKRNNLYNFQ

SEQ ID NO: 3405433 - protein, 18 aa, Plasmodium falciparum
TCCGCIPFTFSPAVTPTI

SEQ ID NO: 3405434 - protein, 19 aa, Plasmodium falciparum
TRKDFRFFLEYTKESWEDQ

SEQ ID NO: 3405435 - protein, 17 aa, Plasmodium falciparum
TSYKRFVVDGASIFLRN

SEQ ID NO: 3405436 - protein, 19 aa, Plasmodium falciparum
VDCPIGWSMMENGFCRAPE

SEQ ID NO: 3405437 - protein, 19 aa, Plasmodium falciparum
VEGKWEIHLGLLKKKKNSK

SEQ ID NO: 3405438 - protein, 18 aa, Plasmodium falciparum
VEKCLKCTLKVKKVEASD

SEQ ID NO: 3405439 - protein, 17 aa, Plasmodium falciparum
VFPLLIYFNYVLHRTYG

SEQ ID NO: 3405440 - protein, 24 aa, Plasmodium falciparum
VIIKSINCLIKWNISSENEYKKNN

SEQ ID NO: 3405441 - protein, 18 aa, Plasmodium falciparum
VLLSIMLMWQIRRQSKIV

SEQ ID NO: 3405442 - protein, 17 aa, Plasmodium falciparum
VTFFFVLLHYISCNKPT

SEQ ID NO: 3405443 - protein, 17 aa, Plasmodium falciparum
VTFKGLMKATGISIPLL

SEQ ID NO: 3405444 - protein, 23 aa, Plasmodium falciparum
VYVNEIINILSFFTFNSEHNLKY

SEQ ID NO: 3405445 - protein, 21 aa, Plasmodium falciparum
YEIGKYIDVVICYIHKKNNII

SEQ ID NO: 3405446 - protein, 23 aa, Plasmodium falciparum
YGAKYYLRSGLFNEKNGKGQKYE

SEQ ID NO: 3405447 - protein, 18 aa, Plasmodium falciparum
YINSYRVGDQFFPTYSNL

SEQ ID NO: 3405448 - protein, 19 aa, Plasmodium falciparum
YKPECYRNRADVNLKVYTL

SEQ ID NO: 3405449 - protein, 21 aa, Plasmodium falciparum
YLYSYCYNGRFFKNGRGSNRN

SEQ ID NO: 3405450 - protein, 17 aa, Plasmodium falciparum
YNFSINCNVSWPCSKIC

SEQ ID NO: 3405451 - protein, 19 aa, Plasmodium falciparum
YNLHECLQFLVVKKNSTCG

SEQ ID NO: 3405452 - protein, 20 aa, Plasmodium falciparum
YSFACPLGWIPSKKINYCKA

SEQ ID NO: 3405453 - protein, 17 aa, Plasmodium falciparum
YSKKGFCIPNMIMPIDV

SEQ ID NO: 3405454 - protein, 25 aa, Plasmodium falciparum
YYCNWKYECMALYNAFHNILNNNYN

SEQ ID NO: 3405455 - protein, 24 aa, Plasmodium falciparum
NVSLFFLLIFKYSYKNIVKKDLQD

SEQ ID NO: 3405456 - protein, 22 aa, Plasmodium falciparum
ALFVFLICVFPCITEDTHKYVY

SEQ ID NO: 3405457 - protein, 21 aa, Plasmodium falciparum
FLIYLILFQCIRNYKHLSTLQ

SEQ ID NO: 3405458 - protein, 23 aa, Plasmodium falciparum
IEIMPNVIYRFLDFGKVGIAYGK

SEQ ID NO: 3405459 - protein, 24 aa, Plasmodium falciparum
NETQLEWLCLDLDLVEGLLNHINE

SEQ ID NO: 3405460 - protein, 26 aa, Plasmodium falciparum
NVKLPRNFFELYKFPLEILKHYYKKT

SEQ ID NO: 3405461 - protein, 25 aa, Plasmodium falciparum
AASLNYIPSILTLAYKFLYGINMKQ

SEQ ID NO: 3405462 - protein, 17 aa, Plasmodium falciparum
ACILKYSYPRDDQKWRA

SEQ ID NO: 3405463 - protein, 22 aa, Plasmodium falciparum
ADFGLFLVPHIYVHVKSEDTEI

SEQ ID NO: 3405464 - protein, 27 aa, Plasmodium falciparum
ADKYMLGILFIWIWNDHHLWECSDPLT

SEQ ID NO: 3405465 - protein, 40 aa, Plasmodium falciparum
AEFKGKIFRNIIVLSRHILFLLEGLELIEYIKIALNYNDN

SEQ ID NO: 3405466 - protein, 22 aa, Plasmodium falciparum
AENIGRILTRSSSQQKDIHALE

SEQ ID NO: 3405467 - protein, 24 aa, Plasmodium falciparum
AESCGFIFRIVGERNYWSLMIDKK

SEQ ID NO: 3405468 - protein, 18 aa, Plasmodium falciparum
AEYRLFLRPDNCDIRLTP

SEQ ID NO: 3405469 - protein, 22 aa, Plasmodium falciparum
AFSFIGFPKRGEGRYLFGRNQM

SEQ ID NO: 3405470 - protein, 18 aa, Plasmodium falciparum
AGAKYRGDFEERLKSILK

SEQ ID NO: 3405471 - protein, 28 aa, Plasmodium falciparum
AHFNSTHIIIYYISQPLLLEPHVVYEET

SEQ ID NO: 3405472 - protein, 26 aa, Plasmodium falciparum
AHGNKMVLLKRYITVGGIPLQEFINN

SEQ ID NO: 3405473 - protein, 26 aa, Plasmodium falciparum
AIISVDKYLLFLSLKDDNMLEMTGVN

SEQ ID NO: 3405474 - protein, 31 aa, Plasmodium falciparum
AIKKKLFVFPLCFIKVYPFIFKNKVAFQNVE

SEQ ID NO: 3405475 - protein, 17 aa, Plasmodium falciparum
AIYLYDLSSKYIQDLEK

SEQ ID NO: 3405476 - protein, 20 aa, Plasmodium falciparum
AKYIVRFLQQRLRIGVNSAT

SEQ ID NO: 3405477 - protein, 24 aa, Plasmodium falciparum
AKYNRIYMMKIIEKIIYEETKCTL

SEQ ID NO: 3405478 - protein, 28 aa, Plasmodium falciparum
ALCTLTLHLFCIFLCLGKEVRSEENGKI

SEQ ID NO: 3405479 - protein, 23 aa, Plasmodium falciparum
ALKTNLRNGYLNNTYFNEENNNL

SEQ ID NO: 3405480 - protein, 18 aa, Plasmodium falciparum
ALLFVPYKCLIITLKNDN

SEQ ID NO: 3405481 - protein, 21 aa, Plasmodium falciparum
ALSFLTEYYPGIAPKLYKVLI

SEQ ID NO: 3405482 - protein, 17 aa, Plasmodium falciparum
ALYYNKIKLKRFINNNK

SEQ ID NO: 3405483 - protein, 17 aa, Plasmodium falciparum
AMRGAIKFILRIKNKGK

SEQ ID NO: 3405484 - protein, 31 aa, Plasmodium falciparum
ANISVGMNFIWPINFVPLLSKQYTKRLGQPI

SEQ ID NO: 3405485 - protein, 23 aa, Plasmodium falciparum
ANNILIPSILLLNKQHLCTHMKS

SEQ ID NO: 3405486 - protein, 26 aa, Plasmodium falciparum
ANSVEQLFYCYNLFDVSNDSVDSFFL

SEQ ID NO: 3405487 - protein, 24 aa, Plasmodium falciparum
AQSPEYIFLNIKFSHRWSSPGALK

SEQ ID NO: 3405488 - protein, 25 aa, Plasmodium falciparum
ARPTLIFIESVIMTKFAIMYLKKEL

SEQ ID NO: 3405489 - protein, 24 aa, Plasmodium falciparum
ARSIRRALYKYIEDPIAAFLISNI

SEQ ID NO: 3405490 - protein, 24 aa, Plasmodium falciparum
ASSYNLPIIFVIENNNWAIGMESS

SEQ ID NO: 3405491 - protein, 23 aa, Plasmodium falciparum
ATIYVLFSEKLIKWTTASTTQGG

SEQ ID NO: 3405492 - protein, 19 aa, Plasmodium falciparum
AVLILNGILNIHVSKKKTS

SEQ ID NO: 3405493 - protein, 17 aa, Plasmodium falciparum
AYDVKHIIIDNLQFMLN

SEQ ID NO: 3405494 - protein, 22 aa, Plasmodium falciparum
AYICFIYMRAKCEALKINNILN

SEQ ID NO: 3405495 - protein, 19 aa, Plasmodium falciparum
AYLLGSLSFMRNFFTVFVR

SEQ ID NO: 3405496 - protein, 20 aa, Plasmodium falciparum
AYNFSKVKQTFLWPYSPPKI

SEQ ID NO: 3405497 - protein, 18 aa, Plasmodium falciparum
AYQLVPWSQVLFSEFNST

SEQ ID NO: 3405498 - protein, 22 aa, Plasmodium falciparum
AYTYYLLLCELIKNKEKQLKQE

SEQ ID NO: 3405499 - protein, 23 aa, Plasmodium falciparum
CAGLAYKFVVPGAATPYAGEPAP

SEQ ID NO: 3405500 - protein, 20 aa, Plasmodium falciparum
CAGYKYPFASSGILCTGHEK

SEQ ID NO: 3405501 - protein, 25 aa, Plasmodium falciparum
CDEDPFCNYFLYNQKKKEIRLCYDK

SEQ ID NO: 3405502 - protein, 24 aa, Plasmodium falciparum
CDLTTIPRLNILKKFKCFIKDIEE

SEQ ID NO: 3405503 - protein, 33 aa, Plasmodium falciparum
CDVNKKQSFKFILYLQHDLITIKWKVYEEKPDT

SEQ ID NO: 3405504 - protein, 17 aa, Plasmodium falciparum
CEKLKHMIYYYYEEYVM

SEQ ID NO: 3405505 - protein, 17 aa, Plasmodium falciparum
CEKYWPECRGTAVPGYC

SEQ ID NO: 3405506 - protein, 18 aa, Plasmodium falciparum
CENVILLKFYFRSDLETL

SEQ ID NO: 3405507 - protein, 28 aa, Plasmodium falciparum
CFARAVTLYLFYYYLKDIKSMLSTDDYQ

SEQ ID NO: 3405508 - protein, 25 aa, Plasmodium falciparum
CFDKKYKIVQIFDELINCPNIILNK

SEQ ID NO: 3405509 - protein, 23 aa, Plasmodium falciparum
CFICLFFLCILKGVYNVKTQKNE

SEQ ID NO: 3405510 - protein, 26 aa, Plasmodium falciparum
CGNLGNLLAPLLKGIKSNLFSKYVNE

SEQ ID NO: 3405511 - protein, 23 aa, Plasmodium falciparum
CICIILVLCSVQRCLSDEQNIND

SEQ ID NO: 3405512 - protein, 17 aa, Plasmodium falciparum
CIFIGLPNVGKSALINR

SEQ ID NO: 3405513 - protein, 27 aa, Plasmodium falciparum
CIFLVLFTFIDIVKPFKGNYGEANFSF

SEQ ID NO: 3405514 - protein, 17 aa, Plasmodium falciparum
CIVIIFFKENISVKIKT

SEQ ID NO: 3405515 - protein, 22 aa, Plasmodium falciparum
CKEKIFIDKLVIGSLDQTKYYS

SEQ ID NO: 3405516 - protein, 18 aa, Plasmodium falciparum
CKFLSVIKKPIISWREQH

SEQ ID NO: 3405517 - protein, 18 aa, Plasmodium falciparum
CKTCIKIIQLLYQIIKQE

SEQ ID NO: 3405518 - protein, 17 aa, Plasmodium falciparum
CLAQFYQDPEKDDILSE

SEQ ID NO: 3405519 - protein, 24 aa, Plasmodium falciparum
CLDVNTSAYIFKLSEFYSKNVLEV

SEQ ID NO: 3405520 - protein, 17 aa, Plasmodium falciparum
CLFFFVVLGACNNVKER

SEQ ID NO: 3405521 - protein, 30 aa, Plasmodium falciparum
CLILFLLYLNFCACMWPWTKKWKAENQMAI

SEQ ID NO: 3405522 - protein, 19 aa, Plasmodium falciparum
CLILFLVCFCQGHKNYLKR

SEQ ID NO: 3405523 - protein, 17 aa, Plasmodium falciparum
CLMLYVSLINLTQSKNV

SEQ ID NO: 3405524 - protein, 17 aa, Plasmodium falciparum
CLQNNRIYARELLYKKI

SEQ ID NO: 3405525 - protein, 23 aa, Plasmodium falciparum
CNALKNIFLDKVTYDYKSFSSYI

SEQ ID NO: 3405526 - protein, 21 aa, Plasmodium falciparum
CNCCFYSIPLIHIYHPNGSMH

SEQ ID NO: 3405527 - protein, 25 aa, Plasmodium falciparum
CNGGYIYLSLKYAYENYLYTQKCFE

SEQ ID NO: 3405528 - protein, 19 aa, Plasmodium falciparum
CNHTATHMLNFMLRKVLTE

SEQ ID NO: 3405529 - protein, 26 aa, Plasmodium falciparum
CPSGLNKWINLWEDVKLFDYKYEPNS

SEQ ID NO: 3405530 - protein, 19 aa, Plasmodium falciparum
CSHVMKLIEFIPESKLSSQ

SEQ ID NO: 3405531 - protein, 27 aa, Plasmodium falciparum
CSKNAKGLNLNKRLLHETQAHVDDAHH

SEQ ID NO: 3405532 - protein, 17 aa, Plasmodium falciparum
CSPFYCEKIMKAKEIER

SEQ ID NO: 3405533 - protein, 29 aa, Plasmodium falciparum
CYNFKRELYIYYNRLSWFTYQMMKMQHED

SEQ ID NO: 3405534 - protein, 18 aa, Plasmodium falciparum
DAGNILKPMLARGELRCI

SEQ ID NO: 3405535 - protein, 21 aa, Plasmodium falciparum
DAKFHFIRRNILDYLMFDFKT

SEQ ID NO: 3405536 - protein, 25 aa, Plasmodium falciparum
DAVKVFHHFIYSLPPYMRNVVFHFF

SEQ ID NO: 3405537 - protein, 25 aa, Plasmodium falciparum
DDEDKRFHLFYYSHNLFKTPETKEK

SEQ ID NO: 3405538 - protein, 21 aa, Plasmodium falciparum
DDIINFCSLLKLVDLSGTFMN

SEQ ID NO: 3405539 - protein, 17 aa, Plasmodium falciparum
DDKFIFNKDIHNILLEL

SEQ ID NO: 3405540 - protein, 19 aa, Plasmodium falciparum
DDNDPCPKDWILKSDEFGT

SEQ ID NO: 3405541 - protein, 32 aa, Plasmodium falciparum
DDTKKFDFIAYIYKDILVFKWKVYEEGLSKEQ

SEQ ID NO: 3405542 - protein, 25 aa, Plasmodium falciparum
DEELLKKYIYYNGPVAAAIEPSSEF

SEQ ID NO: 3405543 - protein, 25 aa, Plasmodium falciparum
DEFKNFIYGIYAYAKKHNYLRLIDS

SEQ ID NO: 3405544 - protein, 22 aa, Plasmodium falciparum
DEILFTIQLIMSKSGYMSKLIP

SEQ ID NO: 3405545 - protein, 18 aa, Plasmodium falciparum
DEIYFFKRLEEAMSIKIG

SEQ ID NO: 3405546 - protein, 31 aa, Plasmodium falciparum
DEKYKSFCFYFIRLVDSISGLFCTIAKRKKR

SEQ ID NO: 3405547 - protein, 22 aa, Plasmodium falciparum
DEKYVCFFCSTSLFIHNKIRSF

SEQ ID NO: 3405548 - protein, 32 aa, Plasmodium falciparum
DELINCPNIILNKINYILRKSKKNIFKEYKKT

SEQ ID NO: 3405549 - protein, 24 aa, Plasmodium falciparum
DEQKKYLEIIKKILDLEEDVLNKE

SEQ ID NO: 3405550 - protein, 27 aa, Plasmodium falciparum
DERKYLYLINGLPWPFKSQDTIYEVYQ

SEQ ID NO: 3405551 - protein, 26 aa, Plasmodium falciparum
DESNKYFLFFNFIFSNPMQSIITLKR

SEQ ID NO: 3405552 - protein, 22 aa, Plasmodium falciparum
DETFIKLCILHKISIKEELVKL

SEQ ID NO: 3405553 - protein, 17 aa, Plasmodium falciparum
DFFNKILLELFYKQREE

SEQ ID NO: 3405554 - protein, 22 aa, Plasmodium falciparum
DFIEHKLLLFEKPVLCNKIIIL

SEQ ID NO: 3405555 - protein, 30 aa, Plasmodium falciparum
DFMYKINLSLNKWFKILKKKKVFEFDVIFS

SEQ ID NO: 3405556 - protein, 28 aa, Plasmodium falciparum
DFNKENLPLFIFANWRGFSGGSMDMFYG

SEQ ID NO: 3405557 - protein, 27 aa, Plasmodium falciparum
DFSNTTIALKTWSLKLGLIKEKHMHLN

SEQ ID NO: 3405558 - protein, 26 aa, Plasmodium falciparum
DGLLLHRHELPYLKKLIILDNLVKPI

SEQ ID NO: 3405559 - protein, 24 aa, Plasmodium falciparum
DGSAFGGGLPFSGYSPLQGNHNKC

SEQ ID NO: 3405560 - protein, 17 aa, Plasmodium falciparum
DGYILPNDVTKYDSNYL

SEQ ID NO: 3405561 - protein, 37 aa, Plasmodium falciparum
DHAHTYFLLNNIIQYSTFFLFWNFSTEFWKRFQYIHN

SEQ ID NO: 3405562 - protein, 33 aa, Plasmodium falciparum
DHLIRESLFIYKPIMKLLLKKYRLRNNKIAIVE

SEQ ID NO: 3405563 - protein, 17 aa, Plasmodium falciparum
DIEALYYNKIKLKRFIN

SEQ ID NO: 3405564 - protein, 31 aa, Plasmodium falciparum; identical to SEQ ID NO: 3380099

SEQ ID NO: 3405565 - protein, 19 aa, Plasmodium falciparum
DIFNNLIRLLKAHPGESTY

SEQ ID NO: 3405566 - protein, 20 aa, Plasmodium falciparum
DIHRLLSRVALNSFLTLNIL

SEQ ID NO: 3405567 - protein, 24 aa, Plasmodium falciparum
DINNPFLSNVLLKSVLGFCILHGF

SEQ ID NO: 3405568 - protein, 26 aa, Plasmodium falciparum
DINSKFLVDILNNSTLNFLENLNSDN

SEQ ID NO: 3405569 - protein, 20 aa, Plasmodium falciparum
DITLYEGLPLLMIEGEKLEG

SEQ ID NO: 3405570 - protein, 32 aa, Plasmodium falciparum
DKALYESSILKYYYLLDKYKKPNRKKIYGYIS

SEQ ID NO: 3405571 - protein, 17 aa, Plasmodium falciparum
DKDIEALYYNKIKLKRF

SEQ ID NO: 3405572 - protein, 22 aa, Plasmodium falciparum
DKINIYYLVLPPWCYVTHWNIR

SEQ ID NO: 3405573 - protein, 39 aa, Plasmodium falciparum
DKKFEPKYFVKNKLRFVSPYVYTYKLFSKKRWVGKKIAD

SEQ ID NO: 3405574 - protein, 24 aa, Plasmodium falciparum
DKKMNILDMLPFDASFDTANDIDE

SEQ ID NO: 3405575 - protein, 25 aa, Plasmodium falciparum
DKKWINFSYYINRIMNYYFHIHDDY

SEQ ID NO: 3405576 - protein, 30 aa, Plasmodium falciparum
DKKYREVFKNFMYGVYSYAKRHNYLDIEKM

SEQ ID NO: 3405577 - protein, 20 aa, Plasmodium falciparum
DKLNFLPLEKTKILCELKPQ

SEQ ID NO: 3405578 - protein, 23 aa, Plasmodium falciparum
DKNNGMFKLLGLYGSNSINWLVT

SEQ ID NO: 3405579 - protein, 19 aa, Plasmodium falciparum
DKNNILLDIKFFDEIKGNQ

SEQ ID NO: 3405580 - protein, 28 aa, Plasmodium falciparum
DKYMLGIVFIAIWNNSYLWYISDPIIDI

SEQ ID NO: 3405581 - protein, 22 aa, Plasmodium falciparum
DLHDIMKLQLFFTMAFKDCNVN

SEQ ID NO: 3405582 - protein, 31 aa, Plasmodium falciparum
DLLYGRVKVHWFPKFMKRVITKIPDYIKVSD

SEQ ID NO: 3405583 - protein, 24 aa, Plasmodium falciparum
DLNDEPLEPFPTQIHKDYKEKNLI

SEQ ID NO: 3405584 - protein, 24 aa, Plasmodium falciparum
DLNIIILFHTIINKINYLLYCGTE

SEQ ID NO: 3405585 - protein, 26 aa, Plasmodium falciparum
DLSIKFIEKILKYILNNINSNLAFDI

SEQ ID NO: 3405586 - protein, 24 aa, Plasmodium falciparum
DLTQMDWPKAIYPLFNNMKLKADI

SEQ ID NO: 3405587 - protein, 18 aa, Plasmodium falciparum
DMFFIYKRELYNICLDDL

SEQ ID NO: 3405588 - protein, 18 aa, Plasmodium falciparum
DMKVLGIDTIGTLYVLPL

SEQ ID NO: 3405589 - protein, 21 aa, Plasmodium falciparum
DMLNNLYSVILFVNFCVAYGD

SEQ ID NO: 3405590 - protein, 25 aa, Plasmodium falciparum
DMNFYGIIGFNFFKNYDTFVLDTIQ

SEQ ID NO: 3405591 - protein, 22 aa, Plasmodium falciparum
DMNKDMLFLYGQNEKIAEDKFL

SEQ ID NO: 3405592 - protein, 23 aa, Plasmodium falciparum
DMNKYFFKNINNVSYHSSGIFLH

SEQ ID NO: 3405593 - protein, 39 aa, Plasmodium falciparum
DMNNLHIYHKYFIIDFGYIYCENKKLLKYVFTKYTKENG

SEQ ID NO: 3405594 - protein, 17 aa, Plasmodium falciparum
DNAYQLVPWSQVLFSEF

SEQ ID NO: 3405595 - protein, 22 aa, Plasmodium falciparum
DNHIYVPFPTPCSVEDALSYYC

SEQ ID NO: 3405596 - protein, 19 aa, Plasmodium falciparum
DNLKNILQIYFKLATDDHN

SEQ ID NO: 3405597 - protein, 19 aa, Plasmodium falciparum
DNLLYFDNYKNKGLLKFLN

SEQ ID NO: 3405598 - protein, 24 aa, Plasmodium falciparum
DNNNKIYIFNVKSWIGAPYDKNVK

SEQ ID NO: 3405599 - protein, 33 aa, Plasmodium falciparum
DNTNPKFSILFLYDKFCYGGIPLACSNLMKYDN

SEQ ID NO: 3405600 - protein, 26 aa, Plasmodium falciparum
DNYKLGVQYFFLRPYISKNDLSFHFY

SEQ ID NO: 3405601 - protein, 26 aa, Plasmodium falciparum
DPNNFEIYKYYQVLNLFKDYNKNTEE

SEQ ID NO: 3405602 - protein, 24 aa, Plasmodium falciparum
DQGNCDTSWIFASKYHLETIRCMK

SEQ ID NO: 3405603 - protein, 21 aa, Plasmodium falciparum
DQLNISTSLKYKLMEAKNNLN

SEQ ID NO: 3405604 - protein, 17 aa, Plasmodium falciparum
DRRNKFLINKNEKCFFF

SEQ ID NO: 3405605 - protein, 22 aa, Plasmodium falciparum
DSFVYFFDKFTYIYNVRTFYQN

SEQ ID NO: 3405606 - protein, 17 aa, Plasmodium falciparum
DSKQYITYLYHSSICQY

SEQ ID NO: 3405607 - protein, 24 aa, Plasmodium falciparum
DSVNGNGFVWTLLGVHKKKPLIDP

SEQ ID NO: 3405608 - protein, 39 aa, Plasmodium falciparum
DSYIYTAPQPFKSLSITLPIIMNKYFSFRISILDDKRCR

SEQ ID NO: 3405609 - protein, 18 aa, Plasmodium falciparum
DTEIIFGKKYYFGLGNYV

SEQ ID NO: 3405610 - protein, 20 aa, Plasmodium falciparum
DTRLLPLFFKELKNIYCEEN

SEQ ID NO: 3405611 - protein, 21 aa, Plasmodium falciparum
DVKHIIIDNLQFMLNINKFSD

SEQ ID NO: 3405612 - protein, 24 aa, Plasmodium falciparum
DVNNPRYSLYFLKDKIKNDTDQCA

SEQ ID NO: 3405613 - protein, 17 aa, Plasmodium falciparum
DVPILLPNNIELSCFLK

SEQ ID NO: 3405614 - protein, 24 aa, Plasmodium falciparum
DVQPKIVDLQIIEPNFVDSQPNPQ

SEQ ID NO: 3405615 - protein, 17 aa, Plasmodium falciparum
DVVLLDVTPLTLGIETV

SEQ ID NO: 3405616 - protein, 32 aa, Plasmodium falciparum
DYGNILHLLHLHSLPIFNYYSGILIDLGVSSH

SEQ ID NO: 3405617 - protein, 27 aa, Plasmodium falciparum
DYINALPDLYLSPYPPVIDLSQNNFQV

SEQ ID NO: 3405618 - protein, 18 aa, Plasmodium falciparum
DYMGLKVTGPCNENFIMF

SEQ ID NO: 3405619 - protein, 17 aa, Plasmodium falciparum
DYSITCPKGWSYSVKDD

SEQ ID NO: 3405620 - protein, 19 aa, Plasmodium falciparum
DYSMPCPLHFFRTSTGCVP

SEQ ID NO: 3405621 - protein, 19 aa, Plasmodium falciparum
DYVETLEKIKKSKVFKHCT

SEQ ID NO: 3405622 - protein, 21 aa, Plasmodium falciparum
EAFFFLAEIILDISMRKQYIS

SEQ ID NO: 3405623 - protein, 27 aa, Plasmodium falciparum
EAKRKRKIFVNIIDILLSIINIAQEKK

SEQ ID NO: 3405624 - protein, 19 aa, Plasmodium falciparum
ECIKLIKEFNIKIIIAITK

SEQ ID NO: 3405625 - protein, 19 aa, Plasmodium falciparum
EDAQVRRFWTNCFITDPDG

SEQ ID NO: 3405626 - protein, 26 aa, Plasmodium falciparum
EDISKWDEKMYYYFGSKDNLSLDNVE

SEQ ID NO: 3405627 - protein, 18 aa, Plasmodium falciparum
EDNFIHSVVIFNVDLPIN

SEQ ID NO: 3405628 - protein, 28 aa, Plasmodium falciparum
EDQKNCALSWAFASIYHLETIKCMKGYE

SEQ ID NO: 3405629 - protein, 18 aa, Plasmodium falciparum
EDRILPFGLKENFWEMAE

SEQ ID NO: 3405630 - protein, 26 aa, Plasmodium falciparum
EEDGLIFIEYPKEINLLPKKVGNLIG

SEQ ID NO: 3405631 - protein, 17 aa, Plasmodium falciparum
EEDIFIFNNLSISLYDI

SEQ ID NO: 3405632 - protein, 25 aa, Plasmodium falciparum
EEDKDHAYLGLIDELLVMNKRYSQN

SEQ ID NO: 3405633 - protein, 23 aa, Plasmodium falciparum
EEEIKNLILKNKKLNIIKNVSDV

SEQ ID NO: 3405634 - protein, 18 aa, Plasmodium falciparum
EEGILDYEDLTENELRKL

SEQ ID NO: 3405635 - protein, 23 aa, Plasmodium falciparum
EEINGKLYKYWIGRNSWGNGWGK

SEQ ID NO: 3405636 - protein, 24 aa, Plasmodium falciparum
EEISYPWNIYGGMSYYFSSENNST

SEQ ID NO: 3405637 - protein, 29 aa, Plasmodium falciparum
EEKCDYMNIFTKPLFYNCYVFKDHGNKIQ

SEQ ID NO: 3405638 - protein, 24 aa, Plasmodium falciparum
EEKFFSDLMKLLYAKPQNGLYYLQ

SEQ ID NO: 3405639 - protein, 17 aa, Plasmodium falciparum
EEKILKLKEKLNKIIIG

SEQ ID NO: 3405640 - protein, 23 aa, Plasmodium falciparum
EEKIQIIHLLKHIKNSKIRRGLV

SEQ ID NO: 3405641 - protein, 25 aa, Plasmodium falciparum
EEKKKKDIYFFFNSGKNLLKRKKST

SEQ ID NO: 3405642 - protein, 23 aa, Plasmodium falciparum
EEKSSSEPPFIPIKNKIDNVHTK

SEQ ID NO: 3405643 - protein, 25 aa, Plasmodium falciparum
EEKSYWLVRNSWGYYWGDEGNFKVD

SEQ ID NO: 3405644 - protein, 30 aa, Plasmodium falciparum
EEKVDLLHFYVFLPIYIKDIYEFNIVCDNS

SEQ ID NO: 3405645 - protein, 17 aa, Plasmodium falciparum
EELLNLKKVYLVQFYAT

SEQ ID NO: 3405646 - protein, 22 aa, Plasmodium falciparum
EELNTWSSFLKNEIFLKQVQAE

SEQ ID NO: 3405647 - protein, 19 aa, Plasmodium falciparum
EEMIKILGLLTVTLWAKEG

SEQ ID NO: 3405648 - protein, 20 aa, Plasmodium falciparum
EENRWYAKDFNYVGGCYGCN

SEQ ID NO: 3405649 - protein, 25 aa, Plasmodium falciparum
EEPKNKYITLFLSNGKKILHSIFRN

SEQ ID NO: 3405650 - protein, 33 aa, Plasmodium falciparum
EEPVLQNLSDIQKLLLHKGSNPYMFNNLRISNN

SEQ ID NO: 3405651 - protein, 25 aa, Plasmodium falciparum
EERDIWITNILKALFCYNTNNLIIV

SEQ ID NO: 3405652 - protein, 26 aa, Plasmodium falciparum
EERNYFLFDLRFIYKTGFFTKRKTII

SEQ ID NO: 3405653 - protein, 28 aa, Plasmodium falciparum
EETKLKEKLLSKLIYGLLISPTVNEKEN

SEQ ID NO: 3405654 - protein, 17 aa, Plasmodium falciparum
EEYIKYNIPEEPIYPYI

SEQ ID NO: 3405655 - protein, 17 aa, Plasmodium falciparum
EFCYLLNIKYCQGYGLT

SEQ ID NO: 3405656 - protein, 34 aa, Plasmodium falciparum
EFENKYINFTWRKLYLGIAWFIHTRGHPIVISPY

SEQ ID NO: 3405657 - protein, 30 aa, Plasmodium falciparum
EFLNRIDEKIIFRQFLKRDIINILQNMIDD

SEQ ID NO: 3405658 - protein, 23 aa, Plasmodium falciparum
EFMRYYIWKRYPSHQLRLYKKIK

SEQ ID NO: 3405659 - protein, 21 aa, Plasmodium falciparum
EFTALGVLFSLLPSLEVELNE

SEQ ID NO: 3405660 - protein, 18 aa, Plasmodium falciparum
EFTLPPVVHKATVFYFIC

SEQ ID NO: 3405661 - protein, 18 aa, Plasmodium falciparum
EGDWFVVRIECIGSKIII

SEQ ID NO: 3405662 - protein, 24 aa, Plasmodium falciparum
EGHLDFVIIPHYTFLDYYKHLSYN

SEQ ID NO: 3405663 - protein, 17 aa, Plasmodium falciparum
EGKKITYDLWNEKALKI

SEQ ID NO: 3405664 - protein, 22 aa, Plasmodium falciparum
EGKLIKLSGYVFQNIVSTDSMP

SEQ ID NO: 3405665 - protein, 18 aa, Plasmodium falciparum
EHMHCNCTFYGPLASVNS

SEQ ID NO: 3405666 - protein, 23 aa, Plasmodium falciparum
EHRVVFFRFKNIPSLHYNIIVEV

SEQ ID NO: 3405667 - protein, 23 aa, Plasmodium falciparum
EHTYDKLLWYKTILKRYIERSKK

SEQ ID NO: 3405668 - protein, 23 aa, Plasmodium falciparum
EIAGAFHSFYMFPAKETLKNVLN

SEQ ID NO: 3405669 - protein, 22 aa, Plasmodium falciparum
EIDNLPFLKRCMVKGVLSLGKS

SEQ ID NO: 3405670 - protein, 24 aa, Plasmodium falciparum
EIIRSYQIMLHFPHPILNNNTINE

SEQ ID NO: 3405671 - protein, 18 aa, Plasmodium falciparum
EIKSFGIRIFIVATYGDG

SEQ ID NO: 3405672 - protein, 24 aa, Plasmodium falciparum
EILNSYIFYIYKYSNYITYKDKVH

SEQ ID NO: 3405673 - protein, 17 aa, Plasmodium falciparum
EILTLRLTKINDELKKL

SEQ ID NO: 3405674 - protein, 18 aa, Plasmodium falciparum
EINLLPKKVGNLIGLRNR

SEQ ID NO: 3405675 - protein, 24 aa, Plasmodium falciparum
EIQGRIYNGLYSKHFRLLAEPSSH

SEQ ID NO: 3405676 - protein, 17 aa, Plasmodium falciparum
EIRAIIESLLRYNKNSP

SEQ ID NO: 3405677 - protein, 26 aa, Plasmodium falciparum
EISKKCHIFWPCENYEILLKKLIYNN

SEQ ID NO: 3405678 - protein, 17 aa, Plasmodium falciparum
EITPQLIRYLYINDNLL

SEQ ID NO: 3405679 - protein, 25 aa, Plasmodium falciparum
EKALIIIKSLLSTNLPYGKTNLTDA

SEQ ID NO: 3405680 - protein, 23 aa, Plasmodium falciparum
EKDYPFYFSFLNMNKINNNKTLP

SEQ ID NO: 3405681 - protein, 26 aa, Plasmodium falciparum
EKEIKFYELILSLMLNENIYYKNIPH

SEQ ID NO: 3405682 - protein, 24 aa, Plasmodium falciparum
EKGYGLMKHYNFPEYNKLEEEKIM

SEQ ID NO: 3405683 - protein, 38 aa, Plasmodium falciparum
EKIKYFFQIYEVHAFDFKLLHYIFSRNQLLNYSEDDLI

SEQ ID NO: 3405684 - protein, 22 aa, Plasmodium falciparum
EKKIFIKILKNVRNKYYIVLIN

SEQ ID NO: 3405685 - protein, 38 aa, Plasmodium falciparum
EKKKHVFYNTCHIILLCATIFKLLIYFMNEKGKVEENL

SEQ ID NO: 3405686 - protein, 33 aa, Plasmodium falciparum
EKKKYKNVLLIFFLYIIFFVSKSYSGKTLACNY

SEQ ID NO: 3405687 - protein, 24 aa, Plasmodium falciparum
EKKSYWLIRNSWGYYWGDEGNFRV

SEQ ID NO: 3405688 - protein, 17 aa, Plasmodium falciparum
EKKYKFIHNLSNTLYTK

SEQ ID NO: 3405689 - protein, 24 aa, Plasmodium falciparum
EKNRKAILLALLKNSLVDNKDYNN

SEQ ID NO: 3405690 - protein, 22 aa, Plasmodium falciparum
EKPIGTFLFLGPTGVGKTELAK

SEQ ID NO: 3405691 - protein, 28 aa, Plasmodium falciparum
EKSKYLLDIPIMKRIEFLLKGYEQDYEK

SEQ ID NO: 3405692 - protein, 23 aa, Plasmodium falciparum
EKYNYEWICIIPTNIYGKYDNFN

SEQ ID NO: 3405693 - protein, 19 aa, Plasmodium falciparum
EKYYFLKYGQFDYNFNEKI

SEQ ID NO: 3405694 - protein, 18 aa, Plasmodium falciparum
ELDPKLIALVIQSIVSAK

SEQ ID NO: 3405695 - protein, 25 aa, Plasmodium falciparum
ELFNNKKILLISLPGAFTPTCSTKM

SEQ ID NO: 3405696 - protein, 20 aa, Plasmodium falciparum
ELFSEVIIQLPIFGTKNVEE

SEQ ID NO: 3405697 - protein, 24 aa, Plasmodium falciparum
ELKEKWIQIGQWYKEPLSPSEWAT

SEQ ID NO: 3405698 - protein, 31 aa, Plasmodium falciparum
ELTKCKSFLSLITPNELFLNDDLGISHNDME

SEQ ID NO: 3405699 - protein, 45 aa, Plasmodium falciparum
EMFIRFNKFLKLKVSFYSLLLLLLFIIYIFFFCSPCYAYNFSKVK

SEQ ID NO: 3405700 - protein, 25 aa, Plasmodium falciparum
ENDLKNIIIQIFNKDIFKNKKKIIN

SEQ ID NO: 3405701 - protein, 24 aa, Plasmodium falciparum
ENDLLKFHPNIDYLTLADGYKLQK

SEQ ID NO: 3405702 - protein, 26 aa, Plasmodium falciparum
ENEILKFCQSFMTNLFRYIGPNTDVP

SEQ ID NO: 3405703 - protein, 18 aa, Plasmodium falciparum
ENGNDLFEYFITLKNEEL

SEQ ID NO: 3405704 - protein, 19 aa, Plasmodium falciparum
ENGQPTFPFFKNINSISGI

SEQ ID NO: 3405705 - protein, 32 aa, Plasmodium falciparum
ENIKITFLMKENINNFLFTQYSYMINKLKEKS

SEQ ID NO: 3405706 - protein, 31 aa, Plasmodium falciparum
ENIYEERNQKILLIHLLKNIKELLNRQRQNF

SEQ ID NO: 3405707 - protein, 28 aa, Plasmodium falciparum
ENIYIRHFIVSLFRWYNNFKLIETCFDK

SEQ ID NO: 3405708 - protein, 17 aa, Plasmodium falciparum
ENKLLFPMVLYNDEYRS

SEQ ID NO: 3405709 - protein, 26 aa, Plasmodium falciparum
ENKSLTHYLFFINIQYQCISPLNLQE

SEQ ID NO: 3405710 - protein, 19 aa, Plasmodium falciparum
ENLWRCHFIYYDEMLEISG

SEQ ID NO: 3405711 - protein, 24 aa, Plasmodium falciparum
ENSLKYFILYKYISNDNKILIPSD

SEQ ID NO: 3405712 - protein, 17 aa, Plasmodium falciparum
ENVFYDFQWGKDFSFEE

SEQ ID NO: 3405713 - protein, 24 aa, Plasmodium falciparum
ENVIKNFLLPNIEKYALLLDDEER

SEQ ID NO: 3405714 - protein, 22 aa, Plasmodium falciparum
ENVPKSIVYKKLFYSITNNEDS

SEQ ID NO: 3405715 - protein, 25 aa, Plasmodium falciparum
EPTNEDILPNHNPLENIKQSESEIN

SEQ ID NO: 3405716 - protein, 26 aa, Plasmodium falciparum
EQIHNFLSYLFKYTNMQISYHCNFVC

SEQ ID NO: 3405717 - protein, 19 aa, Plasmodium falciparum
EQNSVLCSYWLLYHKISVY

SEQ ID NO: 3405718 - protein, 30 aa, Plasmodium falciparum
ERANLNEILTLYFYVLNPGLRNVIYKHFIK

SEQ ID NO: 3405719 - protein, 21 aa, Plasmodium falciparum
EREYFLKYLGMSYDIIKGNPW

SEQ ID NO: 3405720 - protein, 27 aa, Plasmodium falciparum
ERFLIDLNFFLYNGFLRITEDKHLINA

SEQ ID NO: 3405721 - protein, 21 aa, Plasmodium falciparum
ERLIQKIELILRKLDGMNEEE

SEQ ID NO: 3405722 - protein, 20 aa, Plasmodium falciparum
ERNMMFPIHLGVTEAGFGDN

SEQ ID NO: 3405723 - protein, 41 aa, Plasmodium falciparum
ESEEILKEPVLSKVLYNEILFENIKISTPGEYNICLAQFYQ

SEQ ID NO: 3405724 - protein, 21 aa, Plasmodium falciparum
ESFIIFLWRIHNAVTLRSMYD

SEQ ID NO: 3405725 - protein, 24 aa, Plasmodium falciparum
ESINNWWLYLTKQILCLHKGELRN

SEQ ID NO: 3405726 - protein, 24 aa, Plasmodium falciparum
ESKFYLVHNPLFNPLDNLLQNIVH

SEQ ID NO: 3405727 - protein, 28 aa, Plasmodium falciparum
ESLEFFKNIFLFYPPFEVTKHIRYINEY

SEQ ID NO: 3405728 - protein, 27 aa, Plasmodium falciparum
ESSNLKYLWRIPIINNLYNLCCKDKPE

SEQ ID NO: 3405729 - protein, 26 aa, Plasmodium falciparum
ESVFTRIHIIILQKKIERFLSDYTTC

SEQ ID NO: 3405730 - protein, 23 aa, Plasmodium falciparum
ETELEWLCLDLELVEGLLAHRNE

SEQ ID NO: 3405731 - protein, 32 aa, Plasmodium falciparum
ETPIKDFEWSGFPTIFFVKAGSKIPLPYEGER

SEQ ID NO: 3405732 - protein, 18 aa, Plasmodium falciparum
ETSPGSCFWLPHGSKIYN

SEQ ID NO: 3405733 - protein, 22 aa, Plasmodium falciparum
EVDKPIVFGIRKGKFVTIHKET

SEQ ID NO: 3405734 - protein, 24 aa, Plasmodium falciparum
EVLLSIMLMWQIRRQSKIVEEKNG

SEQ ID NO: 3405735 - protein, 32 aa, Plasmodium falciparum
EVVVFFKDNILQPVEGILLGSPSVFHVIINLN

SEQ ID NO: 3405736 - protein, 26 aa, Plasmodium falciparum
EVWKNKFFMQLPKLLNMKNIPIYVPK

SEQ ID NO: 3405737 - protein, 19 aa, Plasmodium falciparum
EWIHVNLHFDKSTFKVIII

SEQ ID NO: 3405738 - protein, 17 aa, Plasmodium falciparum
EYFHLSTMKFANPHISH

SEQ ID NO: 3405739 - protein, 30 aa, Plasmodium falciparum
EYFNFDIYSIFKFLTIDIRFLFYPSCHDES

SEQ ID NO: 3405740 - protein, 18 aa, Plasmodium falciparum
EYTFSYIFDTRLLRVHTL

SEQ ID NO: 3405741 - protein, 18 aa, Plasmodium falciparum
EYVHMFRILFELYAQYNK

SEQ ID NO: 3405742 - protein, 26 aa, Plasmodium falciparum
FARAFSVYLLHFYAKDLKMMIRNEEH

SEQ ID NO: 3405743 - protein, 18 aa, Plasmodium falciparum
FCEKDVCLLALLPNKEDT

SEQ ID NO: 3405744 - protein, 20 aa, Plasmodium falciparum
FCFLCIIIKIKYASSGEGIF

SEQ ID NO: 3405745 - protein, 19 aa, Plasmodium falciparum
FCFVFSQIKSVISQKSTFC

SEQ ID NO: 3405746 - protein, 22 aa, Plasmodium falciparum
FCIFLFFNVVLSKLDFANEQIA

SEQ ID NO: 3405747 - protein, 23 aa, Plasmodium falciparum
FCLLFQYLCIFQNKVSTNDITKE

SEQ ID NO: 3405748 - protein, 20 aa, Plasmodium falciparum
FCSPCYAYNFSKVKQTFLWP

SEQ ID NO: 3405749 - protein, 20 aa, Plasmodium falciparum
FCSWILIKGYIINKNEVKYF

SEQ ID NO: 3405750 - protein, 17 aa, Plasmodium falciparum
FDFKEIFSFLNYDDIGA

SEQ ID NO: 3405751 - protein, 32 aa, Plasmodium falciparum
FDILTREELKTLIYYFVSIPPQVISALKELSI

SEQ ID NO: 3405752 - protein, 17 aa, Plasmodium falciparum
FDKFIDEFFSYYNIHVN

SEQ ID NO: 3405753 - protein, 26 aa, Plasmodium falciparum
FDLINMKIYFISPDKTYILLEDIIRE

SEQ ID NO: 3405754 - protein, 18 aa, Plasmodium falciparum
FDNLLKQNPNVDPQFSFY

SEQ ID NO: 3405755 - protein, 25 aa, Plasmodium falciparum
FEDIPKEHYNLFLKYKNLLFEQIAE

SEQ ID NO: 3405756 - protein, 18 aa, Plasmodium falciparum
FESLKLINKLHQAGICHL

SEQ ID NO: 3405757 - protein, 18 aa, Plasmodium falciparum
FETLINSVRIAWKALTNY

SEQ ID NO: 3405758 - protein, 22 aa, Plasmodium falciparum
FFCLIIVFFSSSFVFSRGNQIS

SEQ ID NO: 3405759 - protein, 20 aa, Plasmodium falciparum
FFCSFLIWVNTMNPGRQGNE

SEQ ID NO: 3405760 - protein, 21 aa, Plasmodium falciparum
FFFFFCFYFEISFCENDKKEE

SEQ ID NO: 3405761 - protein, 23 aa, Plasmodium falciparum
FFFLFFVLCVIQENVRRVLCDSS

SEQ ID NO: 3405762 - protein, 23 aa, Plasmodium falciparum
FFFSFFLLKALNFVSMVYDEEGK

SEQ ID NO: 3405763 - protein, 18 aa, Plasmodium falciparum
FFGYAFALFCTVCCFSKK

SEQ ID NO: 3405764 - protein, 20 aa, Plasmodium falciparum
FFIFFLFTIIRASPGNDNNN

SEQ ID NO: 3405765 - protein, 28 aa, Plasmodium falciparum
FFILYSLFMTCLTKKMLFINFFNEINVN

SEQ ID NO: 3405766 - protein, 27 aa, Plasmodium falciparum
FFKQKYIVKYLPYYLKRATMHKFRDVE

SEQ ID NO: 3405767 - protein, 21 aa, Plasmodium falciparum
FFLFFCFFLQQKNILCSYKEC

SEQ ID NO: 3405768 - protein, 20 aa, Plasmodium falciparum
FFLLFFVYKNTNTVVCDNGY

SEQ ID NO: 3405769 - protein, 17 aa, Plasmodium falciparum
FFLLSCIVHLSRCSDNN

SEQ ID NO: 3405770 - protein, 22 aa, Plasmodium falciparum
FFLLSFFLSKICTCLYVTDGSS

SEQ ID NO: 3405771 - protein, 29 aa, Plasmodium falciparum
FFLTECNIYWSFCVILKTKNPAFLPIQIK

SEQ ID NO: 3405772 - protein, 21 aa, Plasmodium falciparum
FFSFFVGSLVGLSFSYVLTKK

SEQ ID NO: 3405773 - protein, 25 aa, Plasmodium falciparum
FFSFVCLFFRVLSCEGIHEKKKINL

SEQ ID NO: 3405774 - protein, 27 aa, Plasmodium falciparum
FFSLVFLVLLLLLSIKTNILEKSSEIQ

SEQ ID NO: 3405775 - protein, 20 aa, Plasmodium falciparum
FFSYAIFYKPYLCKNSKGKY

SEQ ID NO: 3405776 - protein, 19 aa, Plasmodium falciparum
FFTFYIFTLVICNKETYIT

SEQ ID NO: 3405777 - protein, 21 aa, Plasmodium falciparum
FFVAVVFIFLKNASIWEEKGG

SEQ ID NO: 3405778 - protein, 20 aa, Plasmodium falciparum
FGEIFNCNFFKTIKSNIFSL

SEQ ID NO: 3405779 - protein, 17 aa, Plasmodium falciparum
FGNKYIRTFINKKFVCG

SEQ ID NO: 3405780 - protein, 17 aa, Plasmodium falciparum
FICTLNLLINSFFCYGG

SEQ ID NO: 3405781 - protein, 23 aa, Plasmodium falciparum
FIFHILILFYQIYMVLSSSVRKD

SEQ ID NO: 3405782 - protein, 17 aa, Plasmodium falciparum
FIFVIIEFIESYKKNPQ

SEQ ID NO: 3405783 - protein, 18 aa, Plasmodium falciparum
FIHSVVIFNVDLPINQES

SEQ ID NO: 3405784 - protein, 17 aa, Plasmodium falciparum
FIIVIKCYVNCIKKNNK

SEQ ID NO: 3405785 - protein, 19 aa, Plasmodium falciparum
FIIWFIHCTAKRHEYSIKK

SEQ ID NO: 3405786 - protein, 20 aa, Plasmodium falciparum
FIIYIILNCDVLKCEVESSD

SEQ ID NO: 3405787 - protein, 19 aa, Plasmodium falciparum
FILCVIFNKNVIKCTGESQ

SEQ ID NO: 3405788 - protein, 21 aa, Plasmodium falciparum
FINNIFLKPKQYTKVTANIVI

SEQ ID NO: 3405789 - protein, 18 aa, Plasmodium falciparum
FINYHFIKASNYYIKNKV

SEQ ID NO: 3405790 - protein, 17 aa, Plasmodium falciparum
FIPINAFITLENKINYI

SEQ ID NO: 3405791 - protein, 24 aa, Plasmodium falciparum
FISFFQIVLVVLLLCRSINCDSRH

SEQ ID NO: 3405792 - protein, 25 aa, Plasmodium falciparum
FKAKKNFIFLPTWVMKSLNLNCFDV

SEQ ID NO: 3405793 - protein, 23 aa, Plasmodium falciparum
FKDNKCIAPYYYVPPKGCSHSFD

SEQ ID NO: 3405794 - protein, 18 aa, Plasmodium falciparum
FKEESISFAWDLLTNVYK

SEQ ID NO: 3405795 - protein, 25 aa, Plasmodium falciparum
FKFKYFTLEITKFVLRHILKKLPFN

SEQ ID NO: 3405796 - protein, 17 aa, Plasmodium falciparum
FKIMKIVIPQTSGLNIV

SEQ ID NO: 3405797 - protein, 22 aa, Plasmodium falciparum
FKKKLVTCLSLLQVGDPLKIIV

SEQ ID NO: 3405798 - protein, 23 aa, Plasmodium falciparum
FKNKRITMILGRKVYLNTLSKNN

SEQ ID NO: 3405799 - protein, 21 aa, Plasmodium falciparum
FKNLIFLYKNNVNIMQMVFPD

SEQ ID NO: 3405800 - protein, 17 aa, Plasmodium falciparum
FKSPLKRKIILKDILKG

SEQ ID NO: 3405801 - protein, 21 aa, Plasmodium falciparum
FKYMIILFHDSYHAFVDYFEG

SEQ ID NO: 3405802 - protein, 26 aa, Plasmodium falciparum
FLCIILLLLLIYKCTHSYNIKNKNCP

SEQ ID NO: 3405803 - protein, 21 aa, Plasmodium falciparum
FLFFFYFSSSIYGNVVAPKSA

SEQ ID NO: 3405804 - protein, 20 aa, Plasmodium falciparum
FLFFSFVYISNIKCVEEVVN

SEQ ID NO: 3405805 - protein, 20 aa, Plasmodium falciparum
FLIFVFMKINCINYNSFSKR

SEQ ID NO: 3405806 - protein, 23 aa, Plasmodium falciparum
FLIILVLLKCVLSYNLNNDLSKN

SEQ ID NO: 3405807 - protein, 20 aa, Plasmodium falciparum
FLINKNEKCFFFFFKEEKKK

SEQ ID NO: 3405808 - protein, 18 aa, Plasmodium falciparum
FLKHAYVNIYNSLKKYIL

SEQ ID NO: 3405809 - protein, 17 aa, Plasmodium falciparum
FLLAFICIKKSDERKIG

SEQ ID NO: 3405810 - protein, 21 aa, Plasmodium falciparum
FLLFLFWKKGYSIKKGIKRNA

SEQ ID NO: 3405811 - protein, 23 aa, Plasmodium falciparum
FLLFLINIYICEANGTLSENIES

SEQ ID NO: 3405812 - protein, 18 aa, Plasmodium falciparum
FLLILKIVNALKSNRFSS

SEQ ID NO: 3405813 - protein, 23 aa, Plasmodium falciparum
FLLNKINVFLNYKMIIEINITNQ

SEQ ID NO: 3405814 - protein, 20 aa, Plasmodium falciparum
FLLSLFVINLIYVDNGVFNK

SEQ ID NO: 3405815 - protein, 19 aa, Plasmodium falciparum
FLLSLLKVTFIYSKDHVNN

SEQ ID NO: 3405816 - protein, 20 aa, Plasmodium falciparum
FLLYIFLNKYFISCVKKDPY

SEQ ID NO: 3405817 - protein, 25 aa, Plasmodium falciparum
FLPIFFFVLIWYVHYVLGQPSDVPN

SEQ ID NO: 3405818 - protein, 22 aa, Plasmodium falciparum
FLQFLMDLYNIFLKIDDLFLEN

SEQ ID NO: 3405819 - protein, 28 aa, Plasmodium falciparum
FLQNILYHINISPYLYKLFELTHIDKKC

SEQ ID NO: 3405820 - protein, 17 aa, Plasmodium falciparum
FLSLLAVGLLSNKITKQ

SEQ ID NO: 3405821 - protein, 20 aa, Plasmodium falciparum
FLTTLFLVVLKFHVVKNVKN

SEQ ID NO: 3405822 - protein, 25 aa, Plasmodium falciparum
FLVFFYIIFLNPILSKKVYLNNNIL

SEQ ID NO: 3405823 - protein, 22 aa, Plasmodium falciparum
FLVICLLCCLLSTYVSVIEGHR

SEQ ID NO: 3405824 - protein, 18 aa, Plasmodium falciparum
FLYNYILSKQMNGSLILR

SEQ ID NO: 3405825 - protein, 20 aa, Plasmodium falciparum
FMLIFIRSYTYAIKYKINKA

SEQ ID NO: 3405826 - protein, 19 aa, Plasmodium falciparum
FMRDYALLIYLGTKENYYN

SEQ ID NO: 3405827 - protein, 18 aa, Plasmodium falciparum
FMRNFFTVFVRGTESRPS

SEQ ID NO: 3405828 - protein, 26 aa, Plasmodium falciparum
FNEEDFRLIPLNDFFNKILLELFYKQ

SEQ ID NO: 3405829 - protein, 25 aa, Plasmodium falciparum
FNEYQNNFFFNKILKRSSSNSIKQI

SEQ ID NO: 3405830 - protein, 30 aa, Plasmodium falciparum
FNGSYAFLRYKSFYDFVFSTYVNIKGVGSV

SEQ ID NO: 3405831 - protein, 32 aa, Plasmodium falciparum
FNHEAPQLIGNNYVFTSIYDTKENLIKFLKKN

SEQ ID NO: 3405832 - protein, 19 aa, Plasmodium falciparum
FNKWREIFLQDWTANQKWK

SEQ ID NO: 3405833 - protein, 22 aa, Plasmodium falciparum
FNSSVEYLQRKGILFFVSASNC

SEQ ID NO: 3405834 - protein, 23 aa, Plasmodium falciparum
FNTLMLKADYFIRDINTRGFREV

SEQ ID NO: 3405835 - protein, 33 aa, Plasmodium falciparum
FNTQNAKYLNLYPYYLIFPFNHIGKKELKNNPT

SEQ ID NO: 3405836 - protein, 18 aa, Plasmodium falciparum
FNVPLNYNHDYDYNYFEN

SEQ ID NO: 3405837 - protein, 21 aa, Plasmodium falciparum
FPLLIFLLSYNGSYANYNIKT

SEQ ID NO: 3405838 - protein, 17 aa, Plasmodium falciparum
FPMVLYNDEYRSQINVN

SEQ ID NO: 3405839 - protein, 24 aa, Plasmodium falciparum
FPYILFLILLRTYAYKNPRFSSLS

SEQ ID NO: 3405840 - protein, 18 aa, Plasmodium falciparum
FQNTVHYLLLINNKKKKN

SEQ ID NO: 3405841 - protein, 25 aa, Plasmodium falciparum
FQVPPYIDIKEPFYFMFGCNNNKGE

SEQ ID NO: 3405842 - protein, 25 aa, Plasmodium falciparum
FSEENKLFYGIKKFSVYSNRIKSIV

SEQ ID NO: 3405843 - protein, 26 aa, Plasmodium falciparum
FSENLFHTLLFDLDVDKNLYTLDESL

SEQ ID NO: 3405844 - protein, 28 aa, Plasmodium falciparum
FSFFFFLFPVFCFFQCYGIYKNKKISKA

SEQ ID NO: 3405845 - protein, 23 aa, Plasmodium falciparum
FSFFFVYLYYVSCNQSTHSTPVN

SEQ ID NO: 3405846 - protein, 20 aa, Plasmodium falciparum
FSIDLIVDILKRTQLEWLCI

SEQ ID NO: 3405847 - protein, 22 aa, Plasmodium falciparum
FSLFILNLHIYIKNIKCNDLIN

SEQ ID NO: 3405848 - protein, 20 aa, Plasmodium falciparum
FSLIWIFLYNEKAKDNSFLM

SEQ ID NO: 3405849 - protein, 22 aa, Plasmodium falciparum
FSLLLFVIRWNIISCNKNDKNQ

SEQ ID NO: 3405850 - protein, 30 aa, Plasmodium falciparum
FSNILQYLKNLFYLIKPKKLIYIGVDGVSP

SEQ ID NO: 3405851 - protein, 28 aa, Plasmodium falciparum
FSRIHPLNFEYFLRKLNKYIYNGNIYEK

SEQ ID NO: 3405852 - protein, 22 aa, Plasmodium falciparum
FSSAYPMEWLPVIYRDVFEQIE

SEQ ID NO: 3405853 - protein, 24 aa, Plasmodium falciparum
FSSENFLYYINLSKFSLLEIIDNY

SEQ ID NO: 3405854 - protein, 35 aa, Plasmodium falciparum
FSTKCFSNGLLKNQNILNKSFDSITGRLLNETELE

SEQ ID NO: 3405855 - protein, 17 aa, Plasmodium falciparum
FSVGWRRYQSIPIYSIS

SEQ ID NO: 3405856 - protein, 20 aa, Plasmodium falciparum
FTEYQWSYLNDKKWINFSYY

SEQ ID NO: 3405857 - protein, 17 aa, Plasmodium falciparum
FTGKYSHLFTYSKKPLP

SEQ ID NO: 3405858 - protein, 18 aa, Plasmodium falciparum
FTILLSTSLGWNINKLYR

SEQ ID NO: 3405859 - protein, 21 aa, Plasmodium falciparum
FVALLAGLIKKKVECIELSAS

SEQ ID NO: 3405860 - protein, 31 aa, Plasmodium falciparum
FVEIKEKGFFKYIISYFRKNNRKYLNDDNYL

SEQ ID NO: 3405861 - protein, 43 aa, Plasmodium falciparum
FVFDCSCYLLVPYCRYFDVLYFPTFRLLFPVYDKINDKEYKYI

SEQ ID NO: 3405862 - protein, 21 aa, Plasmodium falciparum
FVFVLFFYITNYNVIYGQMCT

SEQ ID NO: 3405863 - protein, 26 aa, Plasmodium falciparum
FVIIGLIYVWDITYSKKAKIFFNKND

SEQ ID NO: 3405864 - protein, 21 aa, Plasmodium falciparum
FVLFILLKRYKCLSKKKNRCH

SEQ ID NO: 3405865 - protein, 21 aa, Plasmodium falciparum
FVLFINKIVGVKIHLYRKYPN

SEQ ID NO: 3405866 - protein, 18 aa, Plasmodium falciparum
FVLFNTNLYLNIIKYVPT

SEQ ID NO: 3405867 - protein, 19 aa, Plasmodium falciparum
FVLFYFITPKLCQFEKSLF

SEQ ID NO: 3405868 - protein, 31 aa, Plasmodium falciparum
FVLYLLFLLKFNKRFIFLKSEKITSYINTQI

SEQ ID NO: 3405869 - protein, 17 aa, Plasmodium falciparum
FVPSQFVTIKGYNLHEC

SEQ ID NO: 3405870 - protein, 22 aa, Plasmodium falciparum
FVQKDYWLKGTIPFLESMVFNS

SEQ ID NO: 3405871 - protein, 17 aa, Plasmodium falciparum
FYCIFKNTVLLQRTNDI

SEQ ID NO: 3405872 - protein, 24 aa, Plasmodium falciparum
FYEGDIYMLPVLKESYWEVKLDEL

SEQ ID NO: 3405873 - protein, 20 aa, Plasmodium falciparum
FYFILLLMNKSLGGEEKLTK

SEQ ID NO: 3405874 - protein, 25 aa, Plasmodium falciparum
FYGVTGIFAWTYEDALILNTKPTRT

SEQ ID NO: 3405875 - protein, 24 aa, Plasmodium falciparum
FYIAVLFGLIFLNQNVCTQKGPYE

SEQ ID NO: 3405876 - protein, 24 aa, Plasmodium falciparum
FYIFLILNFSFFQSNATSKEIQKD

SEQ ID NO: 3405877 - protein, 17 aa, Plasmodium falciparum
FYKSSFYGLYVQSGYAT

SEQ ID NO: 3405878 - protein, 18 aa, Plasmodium falciparum
FYLIFQAITCFSVNQINV

SEQ ID NO: 3405879 - protein, 17 aa, Plasmodium falciparum
FYTSILKEKFYQSFGVD

SEQ ID NO: 3405880 - protein, 18 aa, Plasmodium falciparum
GAELFKKKLFFDADNSGT

SEQ ID NO: 3405881 - protein, 24 aa, Plasmodium falciparum
GARIGLYNFLMDKIRIEWKDEQKK

SEQ ID NO: 3405882 - protein, 24 aa, Plasmodium falciparum
GCISLYSIIFYTAKISCTVQVKNG

SEQ ID NO: 3405883 - protein, 17 aa, Plasmodium falciparum
GEILSDINSKFLVDILN

SEQ ID NO: 3405884 - protein, 40 aa, Plasmodium falciparum
GERKRFYFDVLAADKFMVATFFIWLWNEGHLWDKATASQD

SEQ ID NO: 3405885 - protein, 18 aa, Plasmodium falciparum
GFCIPNMIMPIDVLSEKD

SEQ ID NO: 3405886 - protein, 17 aa, Plasmodium falciparum
GFTLMFPSTPFNPNDKM

SEQ ID NO: 3405887 - protein, 21 aa, Plasmodium falciparum
GGGNPYFLLLSGISSEEEMCL

SEQ ID NO: 3405888 - protein, 19 aa, Plasmodium falciparum
GGMFFIRNSFLYRNKNFLK

SEQ ID NO: 3405889 - protein, 25 aa, Plasmodium falciparum
GGNFKSPLYDKYGGKLQKFKRQRAF

SEQ ID NO: 3405890 - protein, 24 aa, Plasmodium falciparum
GGSMDMFYGILKFGSMIVNQLVNY

SEQ ID NO: 3405891 - protein, 24 aa, Plasmodium falciparum
GHKNYLKRDNYLQYLRSQTFLQER

SEQ ID NO: 3405892 - protein, 34 aa, Plasmodium falciparum
GIEKMNIIHPLLYFNGIFIFDMMYQYIGTTEIGY

SEQ ID NO: 3405893 - protein, 24 aa, Plasmodium falciparum
GIGRLIFCILEHSFRIRRFTDDKE

SEQ ID NO: 3405894 - protein, 21 aa, Plasmodium falciparum
GIHNYKVKCIFIGLPNVGKSA

SEQ ID NO: 3405895 - protein, 26 aa, Plasmodium falciparum
GIISVDKYLLFISLKNDNMLEKTGVT

SEQ ID NO: 3405896 - protein, 24 aa, Plasmodium falciparum
GISPYISFLKKLFAYDKNNLYNRN

SEQ ID NO: 3405897 - protein, 25 aa, Plasmodium falciparum
GITGYPTLILFNKKNKINYGGGRTA

SEQ ID NO: 3405898 - protein, 17 aa, Plasmodium falciparum
GIYNILPLGFRVINKII

SEQ ID NO: 3405899 - protein, 18 aa, Plasmodium falciparum
GKDIKKFLFTENENILAI

SEQ ID NO: 3405900 - protein, 19 aa, Plasmodium falciparum
GKFTKPIVVLLKNINKENS

SEQ ID NO: 3405901 - protein, 17 aa, Plasmodium falciparum
GKKYYFGLGNYVRKRIY

SEQ ID NO: 3405902 - protein, 25 aa, Plasmodium falciparum
GKPSKYERKLYWLKKVKLEKEQEMQ

SEQ ID NO: 3405903 - protein, 25 aa, Plasmodium falciparum
GLIKQFLCDVYWKNLDFLIIDTPPG

SEQ ID NO: 3405904 - protein, 19 aa, Plasmodium falciparum
GLKKIGILPLWSNTFSSFD

SEQ ID NO: 3405905 - protein, 17 aa, Plasmodium falciparum
GLKYLFIPSHNSFIKKY

SEQ ID NO: 3405906 - protein, 18 aa, Plasmodium falciparum
GLLKFLNDEKRKYNNCII

SEQ ID NO: 3405907 - protein, 24 aa, Plasmodium falciparum
GLNIKKLLYNFHKKCYQPKNMALT

SEQ ID NO: 3405908 - protein, 19 aa, Plasmodium falciparum
GLYNYFPKYTHEFYHNFYD

SEQ ID NO: 3405909 - protein, 24 aa, Plasmodium falciparum
GNDIRLFVKKIPIKVWVKQYNLMK

SEQ ID NO: 3405910 - protein, 23 aa, Plasmodium falciparum
GNSGYFYILRNNNSFNIKSYILA

SEQ ID NO: 3405911 - protein, 27 aa, Plasmodium falciparum
GNVYVACPPLYKITYNKFFDNSIKDIV

SEQ ID NO: 3405912 - protein, 24 aa, Plasmodium falciparum
GRQWEMVLDNLLVFGLKINYEDIF

SEQ ID NO: 3405913 - protein, 22 aa, Plasmodium falciparum
GRTYLLLYTFDIYKHIAGSAFS

SEQ ID NO: 3405914 - protein, 22 aa, Plasmodium falciparum
GRTYYTLYVINSTGKYIPYQNE

SEQ ID NO: 3405915 - protein, 20 aa, Plasmodium falciparum
GRVNVVPRRDNHKKKMAKIE

SEQ ID NO: 3405916 - protein, 26 aa, Plasmodium falciparum
GSTTYCYMRYTFNFNLEKLNENSRSQ

SEQ ID NO: 3405917 - protein, 23 aa, Plasmodium falciparum
GTAQILKVFNISKLGKVAGCIVK

SEQ ID NO: 3405918 - protein, 29 aa, Plasmodium falciparum
GTYYSYNFYLRFFIHIFSDLHQPLHAINF

SEQ ID NO: 3405919 - protein, 42 aa, Plasmodium falciparum
GVIRKIVPWNKARSFFYYRLMRRLLINILSRKYDNALIKNEE

SEQ ID NO: 3405920 - protein, 17 aa, Plasmodium falciparum
GVKINIWSRDIKFLNTD

SEQ ID NO: 3405921 - protein, 38 aa, Plasmodium falciparum
GYCSLKLMMKPGSFLPVKIFLFAFSEYNYINTKAFYKE

SEQ ID NO: 3405922 - protein, 22 aa, Plasmodium falciparum
GYDIYACPRGWLNLMNSGACKA

SEQ ID NO: 3405923 - protein, 17 aa, Plasmodium falciparum
GYNIYKYFLNIITNVER

SEQ ID NO: 3405924 - protein, 17 aa, Plasmodium falciparum
HAGIYDKHYLIHLRVIN

SEQ ID NO: 3405925 - protein, 18 aa, Plasmodium falciparum
HAIGIQNFKSLFIYMLCK

SEQ ID NO: 3405926 - protein, 18 aa, Plasmodium falciparum
HDIYNYLKILKDNKKKVL

SEQ ID NO: 3405927 - protein, 27 aa, Plasmodium falciparum
HDNMDRIPQYLRWFREWGTYVCSEYKN

SEQ ID NO: 3405928 - protein, 26 aa, Plasmodium falciparum
HEKDSQICFFILKLLKKNYKSFDEDI

SEQ ID NO: 3405929 - protein, 27 aa, Plasmodium falciparum
HELFEIPPLIIFLRFFFHEKNEELFTF

SEQ ID NO: 3405930 - protein, 21 aa, Plasmodium falciparum
HFNFIHSVVIFNVDLPMNNKT

SEQ ID NO: 3405931 - protein, 26 aa, Plasmodium falciparum
HGTFFSYNFLIRYFIHIFGDIHQPLH

SEQ ID NO: 3405932 - protein, 23 aa, Plasmodium falciparum
HHENLQIISLNAPPSPIFDQKDV

SEQ ID NO: 3405933 - protein, 20 aa, Plasmodium falciparum
HHTFFEMLGNWSFGDYFKEE

SEQ ID NO: 3405934 - protein, 27 aa, Plasmodium falciparum
HIDQYKTYFPTLAELYLYIDKRVTIIN

SEQ ID NO: 3405935 - protein, 23 aa, Plasmodium falciparum
HIHSLINSFYPYNEQINPFLKRA

SEQ ID NO: 3405936 - protein, 25 aa, Plasmodium falciparum
HIINNLFLHFFKKNKAHLLQQNQLQ

SEQ ID NO: 3405937 - protein, 24 aa, Plasmodium falciparum
HIKQYPPIYSAKRFKGLRLYEYAR

SEQ ID NO: 3405938 - protein, 17 aa, Plasmodium falciparum
HIKRSLNSLLNKDIKIL

SEQ ID NO: 3405939 - protein, 27 aa, Plasmodium falciparum
HIKSVNRCFIPFISEYIYKQKNRKNNI

SEQ ID NO: 3405940 - protein, 27 aa, Plasmodium falciparum
HISKVKTDFIFYFPSEKFTFYESVFTR

SEQ ID NO: 3405941 - protein, 26 aa, Plasmodium falciparum
HITEDGYIFLTLFHTVIFTSNNDAYG

SEQ ID NO: 3405942 - protein, 25 aa, Plasmodium falciparum
HIYERVLVHILFMLGGTINIWSKDI

SEQ ID NO: 3405943 - protein, 27 aa, Plasmodium falciparum
HKGNYNYFFPYPTNTNYYYILQTFNHM

SEQ ID NO: 3405944 - protein, 32 aa, Plasmodium falciparum
HKSNFFINSSLKYIYMYLTPSDSFNLVRRNRN

SEQ ID NO: 3405945 - protein, 17 aa, Plasmodium falciparum
HLEYINIPFSRSIFKSN

SEQ ID NO: 3405946 - protein, 29 aa, Plasmodium falciparum
HLKNVRSLNGIIIHWAYTPGEVSILASYD

SEQ ID NO: 3405947 - protein, 18 aa, Plasmodium falciparum
HLLGKFELSGIPPAQRGV

SEQ ID NO: 3405948 - protein, 23 aa, Plasmodium falciparum
HLNNIFHHLIYVLQMKFNDVPIK

SEQ ID NO: 3405949 - protein, 25 aa, Plasmodium falciparum
HLTVTDIVLILSNNYFKNINSILVN

SEQ ID NO: 3405950 - protein, 18 aa, Plasmodium falciparum
HMLNFMLRKVLTEKYTNS

SEQ ID NO: 3405951 - protein, 17 aa, Plasmodium falciparum
HNFIINRNEFYFLEVIN

SEQ ID NO: 3405952 - protein, 23 aa, Plasmodium falciparum
HNIKKFFVHLINRCINNHEEDSL

SEQ ID NO: 3405953 - protein, 25 aa, Plasmodium falciparum
HNLISNFIHRFGDKFKFFNTPEKIQ

SEQ ID NO: 3405954 - protein, 22 aa, Plasmodium falciparum
HNNYPIIYSNVLYELIENVEKE

SEQ ID NO: 3405955 - protein, 23 aa, Plasmodium falciparum
HPNDKLALVPFQGIKNPIPSNES

SEQ ID NO: 3405956 - protein, 23 aa, Plasmodium falciparum
HQNHGWFRLLGIYGSNSINWLIV

SEQ ID NO: 3405957 - protein, 31 aa, Plasmodium falciparum
HQRIAFSTKYGIPWPCKNKCTFGYDIYACPR

SEQ ID NO: 3405958 - protein, 24 aa, Plasmodium falciparum
HRAQYKFYIALMKALENEKFSQEF

SEQ ID NO: 3405959 - protein, 26 aa, Plasmodium falciparum
HRKYKNDIYPFFIPINNAKEDLIDFN

SEQ ID NO: 3405960 - protein, 37 aa, Plasmodium falciparum
HSNFYIKRFYNKYYFYLHFFKGKFYWCYYNEEADAKM

SEQ ID NO: 3405961 - protein, 35 aa, Plasmodium falciparum
HSRYKNLLMYGIDFNFHVSYFLKGDIQYLPLSYYY

SEQ ID NO: 3405962 - protein, 25 aa, Plasmodium falciparum
HTAGKLPFWLSPRQAIVLPIGDKYN

SEQ ID NO: 3405963 - protein, 24 aa, Plasmodium falciparum
HVETFLYPYFETLNMELNEAGICP

SEQ ID NO: 3405964 - protein, 17 aa, Plasmodium falciparum
HVKIKKLFIKISNVNIF

SEQ ID NO: 3405965 - protein, 25 aa, Plasmodium falciparum
HYYVVFILLYLYDISCFKCIRLNNR

SEQ ID NO: 3405966 - protein, 23 aa, Plasmodium falciparum
IALFIYLDKFHLPNSLKYNFKRS

SEQ ID NO: 3405967 - protein, 30 aa, Plasmodium falciparum
IANEALAYFLARTYLFLLKCGINKDGIRFR

SEQ ID NO: 3405968 - protein, 27 aa, Plasmodium falciparum
IARLVYSFFMRISYLSVSYFDHDIFKI

SEQ ID NO: 3405969 - protein, 24 aa, Plasmodium falciparum
IAVGLAYSILYKNEFHYNPKNTSF

SEQ ID NO: 3405970 - protein, 26 aa, Plasmodium falciparum
ICIFFIPYFCRASFKEYLSNKKIFLK

SEQ ID NO: 3405971 - protein, 24 aa, Plasmodium falciparum
ICISLIFVFIKRSLGLYTNVAEIE

SEQ ID NO: 3405972 - protein, 25 aa, Plasmodium falciparum
ICLCSLILIRTYSALSLKGIKEGDP

SEQ ID NO: 3405973 - protein, 25 aa, Plasmodium falciparum
ICLVTLNLFILEINAKTNTSENRNK

SEQ ID NO: 3405974 - protein, 26 aa, Plasmodium falciparum
ICTFVKYITFQLLNIDISDLKKQLQN

SEQ ID NO: 3405975 - protein, 26 aa, Plasmodium falciparum
IDDADLLIFVLPHQYLDNVLDEIVQN

SEQ ID NO: 3405976 - protein, 35 aa, Plasmodium falciparum
IDFNGYKRSGDYAWSFFWHHFNYDKDTDYNFLNRN

SEQ ID NO: 3405977 - protein, 25 aa, Plasmodium falciparum
IDKCEENFYQTCPYNWIFKDNKCIA

SEQ ID NO: 3405978 - protein, 18 aa, Plasmodium falciparum
IDLPFLDLYIHCSGGTYI

SEQ ID NO: 3405979 - protein, 19 aa, Plasmodium falciparum
IDNFPLLRKDKLKGSLIYF

SEQ ID NO: 3405980 - protein, 17 aa, Plasmodium falciparum
IDPGYRAQIYLMEWALS

SEQ ID NO: 3405981 - protein, 37 aa, Plasmodium falciparum
IDTNYVYYLNHKIPKDIFPFILQLSLAFKYEHTHILI

SEQ ID NO: 3405982 - protein, 25 aa, Plasmodium falciparum
IDVNKILYYILNHYYSKNLTIIKDN

SEQ ID NO: 3405983 - protein, 20 aa, Plasmodium falciparum
IDVYDFFYIKKVLSSRIKKE

SEQ ID NO: 3405984 - protein, 32 aa, Plasmodium falciparum
IELFDIYADKFELLPLKFLKFHGSTNIDQVID

SEQ ID NO: 3405985 - protein, 35 aa, Plasmodium falciparum
IENYYLFNNFKSSFYFHMFILDKLKKQIHVKGLFR

SEQ ID NO: 3405986 - protein, 17 aa, Plasmodium falciparum
IFASLIIVFINVENKAI

SEQ ID NO: 3405987 - protein, 23 aa, Plasmodium falciparum
IFFLFFFHLIKSYNINYHINDKT

SEQ ID NO: 3405988 - protein, 23 aa, Plasmodium falciparum
IFINIYILILNAYCKEWCKATFE

SEQ ID NO: 3405989 - protein, 17 aa, Plasmodium falciparum
IFISTFSWKSILSYRRL

SEQ ID NO: 3405990 - protein, 18 aa, Plasmodium falciparum
IFKLLGIYGSNSINWLAS

SEQ ID NO: 3405991 - protein, 23 aa, Plasmodium falciparum
IFLFFIVLEILLLSDRNFIPSCY

SEQ ID NO: 3405992 - protein, 19 aa, Plasmodium falciparum
IFLYYVNAFKNTQKDGVSL

SEQ ID NO: 3405993 - protein, 18 aa, Plasmodium falciparum
IFNYILKASLDLLLIKPI

SEQ ID NO: 3405994 - protein, 17 aa, Plasmodium falciparum
IFRLFSNDNEKITTALN

SEQ ID NO: 3405995 - protein, 19 aa, Plasmodium falciparum
IFSIYYIDGKSILRNNKSH

SEQ ID NO: 3405996 - protein, 21 aa, Plasmodium falciparum
IFTVILIPLTFCFKNALIKHS

SEQ ID NO: 3405997 - protein, 25 aa, Plasmodium falciparum
IFVILFHLIGYLKNENKCFCQFTDQ

SEQ ID NO: 3405998 - protein, 18 aa, Plasmodium falciparum
IFVLFLDIYDCFKIKNFE

SEQ ID NO: 3405999 - protein, 23 aa, Plasmodium falciparum
IFWFIPYYCFNYVLCVGNKNDML

SEQ ID NO: 3406000 - protein, 18 aa, Plasmodium falciparum
IGAPYDWRYPLSQQNYKI

SEQ ID NO: 3406001 - protein, 28 aa, Plasmodium falciparum
IGDLQNFDKFILPNQFILSSNETDINEN

SEQ ID NO: 3406002 - protein, 17 aa, Plasmodium falciparum
IGILPLWSNTFSSFDLV

SEQ ID NO: 3406003 - protein, 22 aa, Plasmodium falciparum
IGLFHHVILSLKLVNLKKKRSN

SEQ ID NO: 3406004 - protein, 32 aa, Plasmodium falciparum
IHEKIKHFLKLVPRHNFLLDYHFNSIFEKEIK

SEQ ID NO: 3406005 - protein, 26 aa, Plasmodium falciparum
IHPRKIMLVLNLLYKQGNYKALYEMG

SEQ ID NO: 3406006 - protein, 34 aa, Plasmodium falciparum
IHSCSRYLLNSKPFRIWISLSRLLSIQSNIYCTF

SEQ ID NO: 3406007 - protein, 24 aa, Plasmodium falciparum
IIDDYMSYKYPRKLKHLEYINIPF

SEQ ID NO: 3406008 - protein, 18 aa, Plasmodium falciparum
IIELIKYLQKNPSVIHFI

SEQ ID NO: 3406009 - protein, 17 aa, Plasmodium falciparum
IIILALLNCKSYGKSKL

SEQ ID NO: 3406010 - protein, 17 aa, Plasmodium falciparum
IIKDNIYNIIFSTNLPS

SEQ ID NO: 3406011 - protein, 18 aa, Plasmodium falciparum
IIKFGLLLSLDNKNKNVH

SEQ ID NO: 3406012 - protein, 25 aa, Plasmodium falciparum
IIKSQIYRFWVSEPYLKIGRSHTLY

SEQ ID NO: 3406013 - protein, 26 aa, Plasmodium falciparum
IIVDLISSDFIKFVKIKYNDGYVVEV

SEQ ID NO: 3406014 - protein, 24 aa, Plasmodium falciparum
IKDALLYLKFIEKGNLYLIKNVDK

SEQ ID NO: 3406015 - protein, 21 aa, Plasmodium falciparum
IKEINFICKYYIYDNSYEIIK

SEQ ID NO: 3406016 - protein, 25 aa, Plasmodium falciparum
IKEKNFFQLIDYYNDNYISSGRFNI

SEQ ID NO: 3406017 - protein, 26 aa, Plasmodium falciparum
IKELNRRPLFILLKSDNIYEHVLITR

SEQ ID NO: 3406018 - protein, 22 aa, Plasmodium falciparum
IKFRINVYCIVYIAIPKEQKKN

SEQ ID NO: 3406019 - protein, 26 aa, Plasmodium falciparum
IKIENFFNYIQIFCPAKDLGIYKNIQ

SEQ ID NO: 3406020 - protein, 25 aa, Plasmodium falciparum
IKITLKYCPFCPPHKYKYDNMYKHE

SEQ ID NO: 3406021 - protein, 18 aa, Plasmodium falciparum
IKKPIISWREQHGYILGL

SEQ ID NO: 3406022 - protein, 24 aa, Plasmodium falciparum
IKNEIFHTIIYLKKKIGNSVIYDD

SEQ ID NO: 3406023 - protein, 17 aa, Plasmodium falciparum
IKNIFRLKLVNGSTKNV

SEQ ID NO: 3406024 - protein, 19 aa, Plasmodium falciparum
IKRFNVFKDFSFYIDAVKK

SEQ ID NO: 3406025 - protein, 25 aa, Plasmodium falciparum
IKSKLLKDLPFKSKPKLFKKLQNHA

SEQ ID NO: 3406026 - protein, 20 aa, Plasmodium falciparum
IKYILSIKLQKLINIKNIDF

SEQ ID NO: 3406027 - protein, 25 aa, Plasmodium falciparum
IKYNLNILKFLLKYKDLLSKEDINM

SEQ ID NO: 3406028 - protein, 31 aa, Plasmodium falciparum
ILEINLCNPYLWNKHFYYNIALYTEYFLDNC

SEQ ID NO: 3406029 - protein, 18 aa, Plasmodium falciparum
ILFACLIGIVFSSGVDEV

SEQ ID NO: 3406030 - protein, 21 aa, Plasmodium falciparum
ILFLLTYECKTIKKYFYVNNN

SEQ ID NO: 3406031 - protein, 23 aa, Plasmodium falciparum
ILKKTFHDIINKLFLYIKNVFLK

SEQ ID NO: 3406032 - protein, 17 aa, Plasmodium falciparum
ILLDIKFFDEIKGNQKV

SEQ ID NO: 3406033 - protein, 20 aa, Plasmodium falciparum
ILLFLFYQHYVCSTIKPYEI

SEQ ID NO: 3406034 - protein, 21 aa, Plasmodium falciparum
ILLSFVFSVVELIFGYDNIIN

SEQ ID NO: 3406035 - protein, 19 aa, Plasmodium falciparum
ILLTSLLNKCFKIMKIVIP

SEQ ID NO: 3406036 - protein, 29 aa, Plasmodium falciparum
ILMGSYGIGIYRLLYFLIENFYDEEGIKL

SEQ ID NO: 3406037 - protein, 19 aa, Plasmodium falciparum
ILNLFFFEKETSPGSCFWL

SEQ ID NO: 3406038 - protein, 24 aa, Plasmodium falciparum
ILNQNEYELIKRLILAFSNQEESG

SEQ ID NO: 3406039 - protein, 26 aa, Plasmodium falciparum
ILSAAVFASVLLLDNNNSEFNNNLFS

SEQ ID NO: 3406040 - protein, 26 aa, Plasmodium falciparum
ILTIIYIHLFILNRLSFENAIKKTKN

SEQ ID NO: 3406041 - protein, 18 aa, Plasmodium falciparum
ILVYLSFMKGIRIDIWSK

SEQ ID NO: 3406042 - protein, 23 aa, Plasmodium falciparum
ILYLGSCLLASVCTLCICRNREL

SEQ ID NO: 3406043 - protein, 20 aa, Plasmodium falciparum
IMKRSKITWNEKKSHHLYCP

SEQ ID NO: 3406044 - protein, 21 aa, Plasmodium falciparum
IMKSILWDLNVPLLGNCRVEF

SEQ ID NO: 3406045 - protein, 17 aa, Plasmodium falciparum
IMNLYDKILQLKILYNE

SEQ ID NO: 3406046 - protein, 17 aa, Plasmodium falciparum
INEKMFLQNILYHINIS

SEQ ID NO: 3406047 - protein, 23 aa, Plasmodium falciparum
INELSLYFPSIKNPEIFSISPGH

SEQ ID NO: 3406048 - protein, 17 aa, Plasmodium falciparum
INKLYKILHNILQILKN

SEQ ID NO: 3406049 - protein, 18 aa, Plasmodium falciparum
INKYNIFNYILKASLDLL

SEQ ID NO: 3406050 - protein, 22 aa, Plasmodium falciparum
INNIYLKLYEKYKLDYKFVHNE

SEQ ID NO: 3406051 - protein, 29 aa, Plasmodium falciparum
INNNAQGGLLLSSPYQYREQGGCGIISSV

SEQ ID NO: 3406052 - protein, 17 aa, Plasmodium falciparum
INNNNMMMMNIPVDIDK

SEQ ID NO: 3406053 - protein, 30 aa, Plasmodium falciparum
INNTNNVIIKYWKVLNSWGTNWGNSGYFYI

SEQ ID NO: 3406054 - protein, 24 aa, Plasmodium falciparum
IPEEPIYPYISVPNNLYTKTYNEN

SEQ ID NO: 3406055 - protein, 24 aa, Plasmodium falciparum
IPKFIQNNILNQIFPDLIFNLHNT

SEQ ID NO: 3406056 - protein, 17 aa, Plasmodium falciparum
IPPLVKPENHKTIVSAM

SEQ ID NO: 3406057 - protein, 30 aa, Plasmodium falciparum
IQKLPKKKHLLRRWKYDLFEKIKEKMKYED

SEQ ID NO: 3406058 - protein, 22 aa, Plasmodium falciparum
IQLEPRFMKLNERIDFEKDKSN

SEQ ID NO: 3406059 - protein, 22 aa, Plasmodium falciparum
IQNFNKLLWDKVNKLNVNELNY

SEQ ID NO: 3406060 - protein, 23 aa, Plasmodium falciparum
IQNKKHLIYKNKSYNPLLLSCVK

SEQ ID NO: 3406061 - protein, 21 aa, Plasmodium falciparum
IQRAFRPFSYVDLSNITCIYK

SEQ ID NO: 3406062 - protein, 27 aa, Plasmodium falciparum
IQRAKNDLFFIKPSVKLNLCSSKFIHR

SEQ ID NO: 3406063 - protein, 17 aa, Plasmodium falciparum
IRDVIMYDYPFKELRRP

SEQ ID NO: 3406064 - protein, 24 aa, Plasmodium falciparum
IRIYKFIIYIRCLLEWLPQINPHL

SEQ ID NO: 3406065 - protein, 26 aa, Plasmodium falciparum
IRLWVLIVFLILYNIKCICENISDLK

SEQ ID NO: 3406066 - protein, 24 aa, Plasmodium falciparum
IRMSDIVILKLYVNVKIKKFYYFD

SEQ ID NO: 3406067 - protein, 21 aa, Plasmodium falciparum
IRYIFLGTSFSRIHPLNFEYF

SEQ ID NO: 3406068 - protein, 17 aa, Plasmodium falciparum
ISEYIYKQKNRKNNISY

SEQ ID NO: 3406069 - protein, 26 aa, Plasmodium falciparum
ISGCGPAYVYLFIESLIDAGVKNGLS

SEQ ID NO: 3406070 - protein, 26 aa, Plasmodium falciparum
ISKKLSYIYILFHYKDENNFNALEMK

SEQ ID NO: 3406071 - protein, 17 aa, Plasmodium falciparum
ISLICLFFGCSNKLYAL

SEQ ID NO: 3406072 - protein, 18 aa, Plasmodium falciparum
ISRTKYVCLGLKRNSREN

SEQ ID NO: 3406073 - protein, 26 aa, Plasmodium falciparum
ISSCLPIFHHIFVTSCGIIFTNNDCY

SEQ ID NO: 3406074 - protein, 18 aa, Plasmodium falciparum
ITAAFYMNIKPIKVDEEN

SEQ ID NO: 3406075 - protein, 19 aa, Plasmodium falciparum
ITENKYLARKLQLTWGIYP

SEQ ID NO: 3406076 - protein, 28 aa, Plasmodium falciparum
ITESYYCVLIPHIPIIPNTFLPINYNDK

SEQ ID NO: 3406077 - protein, 24 aa, Plasmodium falciparum
ITFIHDILLDLRKNGLYDKICVEN

SEQ ID NO: 3406078 - protein, 23 aa, Plasmodium falciparum
ITKNDIVLVMFYAPWCGHCKRLI

SEQ ID NO: 3406079 - protein, 26 aa, Plasmodium falciparum
ITSSMKPTFQWIAPTGFVGFNGKEND

SEQ ID NO: 3406080 - protein, 18 aa, Plasmodium falciparum
ITWNEKKSHHLYCPMECN

SEQ ID NO: 3406081 - protein, 21 aa, Plasmodium falciparum
IVDKAYDPSFGARPLKRVIQS

SEQ ID NO: 3406082 - protein, 23 aa, Plasmodium falciparum
IVGSPLLFKSLIGLEYIGLNEYF

SEQ ID NO: 3406083 - protein, 19 aa, Plasmodium falciparum
IVGTMFKFLDSKNYTILEI

SEQ ID NO: 3406084 - protein, 18 aa, Plasmodium falciparum
IVILFLTNVLTKKHVISN

SEQ ID NO: 3406085 - protein, 26 aa, Plasmodium falciparum
IVKKYIEGLFWNLHYYHFGCASWYWE

SEQ ID NO: 3406086 - protein, 18 aa, Plasmodium falciparum
IVLIFPFFHSCEALKKGN

SEQ ID NO: 3406087 - protein, 18 aa, Plasmodium falciparum
IVQKLNLTFGFPTVIALS

SEQ ID NO: 3406088 - protein, 24 aa, Plasmodium falciparum
IVYCFISSFYLIKSSSNDKNKINK

SEQ ID NO: 3406089 - protein, 30 aa, Plasmodium falciparum
IWINKNVHKYFYFLNSLYDRMRKISYKLFS

SEQ ID NO: 3406090 - protein, 22 aa, Plasmodium falciparum
IWSFLLCDIYETLNIRKSIDRK

SEQ ID NO: 3406091 - protein, 22 aa, Plasmodium falciparum
IYFFTLLFLLTKCIKNKNRNKI

SEQ ID NO: 3406092 - protein, 22 aa, Plasmodium falciparum
IYIFYIIFLPSYSRGFITPHIK

SEQ ID NO: 3406093 - protein, 25 aa, Plasmodium falciparum
IYKYKHLMKIFLDKYKLDNNKIAIV

SEQ ID NO: 3406094 - protein, 17 aa, Plasmodium falciparum
IYLKQVSFLLYDWFRKN

SEQ ID NO: 3406095 - protein, 23 aa, Plasmodium falciparum
IYSRLLNESILLNKLVFENHKGD

SEQ ID NO: 3406096 - protein, 17 aa, Plasmodium falciparum
IYSTKYPQLTLLNSNNI

SEQ ID NO: 3406097 - protein, 17 aa, Plasmodium falciparum
IYVKKNVLFLNNKYISN

SEQ ID NO: 3406098 - protein, 20 aa, Plasmodium falciparum
KAHPDVYNLLLRVIDEGKLS

SEQ ID NO: 3406099 - protein, 22 aa, Plasmodium falciparum
KAKSIPIYLGRRYSYNTFSTNS

SEQ ID NO: 3406100 - protein, 22 aa, Plasmodium falciparum
KAMRKLIVAANKAKLLLSAKKS

SEQ ID NO: 3406101 - protein, 25 aa, Plasmodium falciparum
KCKKIYFLPLIFLKNNNKDVYIEDH

SEQ ID NO: 3406102 - protein, 46 aa, Plasmodium falciparum
KCPSDYPLYLKNLCGIIVNFKYSSPLFKKNWSYLCKSDWPCFSTCE

SEQ ID NO: 3406103 - protein, 17 aa, Plasmodium falciparum
KCYLGYIYYFIDGYKNL

SEQ ID NO: 3406104 - protein, 24 aa, Plasmodium falciparum
KDAPKVAVLFYYGFDYGANKNMIP

SEQ ID NO: 3406105 - protein, 27 aa, Plasmodium falciparum
KDICTNTIIIPFYKDNYSYIFYDDKEE

SEQ ID NO: 3406106 - protein, 22 aa, Plasmodium falciparum
KDILKSYPIIKYVFGELIIELH

SEQ ID NO: 3406107 - protein, 26 aa, Plasmodium falciparum
KDIQGVWKFFLPVYIMDREFKRAKDM

SEQ ID NO: 3406108 - protein, 17 aa, Plasmodium falciparum
KDNLINYEFILDNLKTS

SEQ ID NO: 3406109 - protein, 24 aa, Plasmodium falciparum
KDSGKLFMEALEKLNINMKDLKKD

SEQ ID NO: 3406110 - protein, 34 aa, Plasmodium falciparum
KDSNKYFKLVLYIKNNILILKWKVQDKDSKPTNI

SEQ ID NO: 3406111 - protein, 40 aa, Plasmodium falciparum
KDVILLGLDFLLNKKLIFDLKNNILIIPKKYLNNTNEFNK

SEQ ID NO: 3406112 - protein, 30 aa, Plasmodium falciparum
KEDIKVYTFYFYKYILIYKNFKKSTCTFES

SEQ ID NO: 3406113 - protein, 34 aa, Plasmodium falciparum
KEELYDINENIFPDYFFLDIFTENKEQKNEEVPM

SEQ ID NO: 3406114 - protein, 23 aa, Plasmodium falciparum
KEENSEVMSLYKTGQHKPKNATE

SEQ ID NO: 3406115 - protein, 26 aa, Plasmodium falciparum
KEEPKVYEKLYVGKLIFGEIFKIEND

SEQ ID NO: 3406116 - protein, 21 aa, Plasmodium falciparum
KEHIYILYLGYRTVNDNYLIY

SEQ ID NO: 3406117 - protein, 20 aa, Plasmodium falciparum
KEIFSFLNYDDIGATFLNYL

SEQ ID NO: 3406118 - protein, 17 aa, Plasmodium falciparum
KEKELLPYYLQVCHKYA

SEQ ID NO: 3406119 - protein, 34 aa, Plasmodium falciparum
KEKESEYFSYFLKYTPNFLYNLFFNNYTTNDEYK

SEQ ID NO: 3406120 - protein, 18 aa, Plasmodium falciparum
KEKIFYWGCFYAEKKEST

SEQ ID NO: 3406121 - protein, 25 aa, Plasmodium falciparum
KEKSESFPLFQNLGLFGKNVLSKVK

SEQ ID NO: 3406122 - protein, 26 aa, Plasmodium falciparum
KELAQRMAIMFTKWLAPDEYGAVVDY

SEQ ID NO: 3406123 - protein, 35 aa, Plasmodium falciparum
KENEALFLQNFPKKTLFLYSYLKDTFAKTIQTLKK

SEQ ID NO: 3406124 - protein, 22 aa, Plasmodium falciparum
KEPIVLIKVPTIDLFDKIRIEE

SEQ ID NO: 3406125 - protein, 27 aa, Plasmodium falciparum
KEQFKNFIYGLYSFAKRHNYLIVNKTN

SEQ ID NO: 3406126 - protein, 28 aa, Plasmodium falciparum
KESHEELFKVFLELINKNDLVKENLKKI

SEQ ID NO: 3406127 - protein, 21 aa, Plasmodium falciparum
KESYVFYYDYPTAGNIEVQIK

SEQ ID NO: 3406128 - protein, 23 aa, Plasmodium falciparum
KETNIYLPSILKNFKNIYKNQDN

SEQ ID NO: 3406129 - protein, 18 aa, Plasmodium falciparum
KFAKMFFPNVLDETFLDS

SEQ ID NO: 3406130 - protein, 29 aa, Plasmodium falciparum
KFHDQFKNFIYGIYGFAKRHSYLRNEKIQ

SEQ ID NO: 3406131 - protein, 18 aa, Plasmodium falciparum
KFIHNLSNTLYTKFLEYI

SEQ ID NO: 3406132 - protein, 22 aa, Plasmodium falciparum
KFKDSLLFTFLTNAFNQIEELK

SEQ ID NO: 3406133 - protein, 17 aa, Plasmodium falciparum
KFMYLNSIKRKDIFIKL

SEQ ID NO: 3406134 - protein, 25 aa, Plasmodium falciparum
KGDKIKKVCDLILKKLKKLENVNKL

SEQ ID NO: 3406135 - protein, 17 aa, Plasmodium falciparum
KGFVSSFFDDLMSLIYF

SEQ ID NO: 3406136 - protein, 25 aa, Plasmodium falciparum
KGKLRYYHNSIYWNYGALPQTYEYP

SEQ ID NO: 3406137 - protein, 23 aa, Plasmodium falciparum
KGNAPFNFTIIPYNYVNNSTEEN

SEQ ID NO: 3406138 - protein, 23 aa, Plasmodium falciparum
KHECIIFPFIKKVDEINMIETNG

SEQ ID NO: 3406139 - protein, 22 aa, Plasmodium falciparum
KHFHDTLLFPQYFSYSFRLRII

SEQ ID NO: 3406140 - protein, 18 aa, Plasmodium falciparum
KHFIKLNKKMKTLNDEEN

SEQ ID NO: 3406141 - protein, 25 aa, Plasmodium falciparum
KHNLIKYDFFLKKKNFILLTGKNMS

SEQ ID NO: 3406142 - protein, 25 aa, Plasmodium falciparum
KHNNNKVFWLIQKRGRKYIPFYDIN

SEQ ID NO: 3406143 - protein, 21 aa, Plasmodium falciparum
KHSMLNYHPKAHLSYLPVSHI

SEQ ID NO: 3406144 - protein, 27 aa, Plasmodium falciparum
KHTHKNHLLFIYIKNHNFILNTKKFKK

SEQ ID NO: 3406145 - protein, 25 aa, Plasmodium falciparum
KIDIKKRFLLPKLQGKYNLYCTTKN

SEQ ID NO: 3406146 - protein, 24 aa, Plasmodium falciparum
KIESFLGIKKWKYLGISTAYKIVG

SEQ ID NO: 3406147 - protein, 19 aa, Plasmodium falciparum
KIFDIFQTIIFIQKFTENV

SEQ ID NO: 3406148 - protein, 28 aa, Plasmodium falciparum
KIIEIHHFMLNELYKIDPEFKKIPNKNE

SEQ ID NO: 3406149 - protein, 19 aa, Plasmodium falciparum
KIIKNIYDLPNTISLSMLS

SEQ ID NO: 3406150 - protein, 21 aa, Plasmodium falciparum
KIILCTLYLVCLKFGHVLNNG

SEQ ID NO: 3406151 - protein, 20 aa, Plasmodium falciparum
KIKLNIWRTFQKDELLKRIL

SEQ ID NO: 3406152 - protein, 22 aa, Plasmodium falciparum
KIKTYLFSIYKKKKKINEIIHN

SEQ ID NO: 3406153 - protein, 26 aa, Plasmodium falciparum
KILNSLPYIFVNHLKYIYPTAENVDH

SEQ ID NO: 3406154 - protein, 25 aa, Plasmodium falciparum
KILPHRYPFLLVDKVIYMQPNKTII

SEQ ID NO: 3406155 - protein, 18 aa, Plasmodium falciparum
KIMDKCPFRWTYIDNNLC

SEQ ID NO: 3406156 - protein, 34 aa, Plasmodium falciparum
KINLYILTVDYILSKLILIYSFDEKIRITVFNNY

SEQ ID NO: 3406157 - protein, 23 aa, Plasmodium falciparum
KINPPNFFLLKNLMNKCHHFIRE

SEQ ID NO: 3406158 - protein, 21 aa, Plasmodium falciparum
KINVLTWLTNVLYPSENPKYF

SEQ ID NO: 3406159 - protein, 18 aa, Plasmodium falciparum
KIRLTLPKQFSWGDPFND

SEQ ID NO: 3406160 - protein, 19 aa, Plasmodium falciparum
KISYKLFSLNYNIDIIGHD

SEQ ID NO: 3406161 - protein, 28 aa, Plasmodium falciparum
KITDLSRIKIYWEYPPLHYNISVSTDNQ

SEQ ID NO: 3406162 - protein, 26 aa, Plasmodium falciparum
KIVPSKKLHITKSDLVFLLSELRQEI

SEQ ID NO: 3406163 - protein, 26 aa, Plasmodium falciparum
KIYDNNHILNIYNFLLVWKQRKNIDL

SEQ ID NO: 3406164 - protein, 28 aa, Plasmodium falciparum
KIYSYKYNYKLMLNLFSSENFLYYINLS

SEQ ID NO: 3406165 - protein, 24 aa, Plasmodium falciparum
KKEDFKSFILKYNELSSPNSNYQE

SEQ ID NO: 3406166 - protein, 27 aa, Plasmodium falciparum
KKEGWRDQIYLYWSSKISIDLYKKIEE

SEQ ID NO: 3406167 - protein, 23 aa, Plasmodium falciparum
KKEPKIYNYYLKASPDFYHNLYY

SEQ ID NO: 3406168 - protein, 23 aa, Plasmodium falciparum
KKESKIYDYYLKASPEFYHNLYF

SEQ ID NO: 3406169 - protein, 23 aa, Plasmodium falciparum
KKGILDMGIKLLFSKVKSLLKKL

SEQ ID NO: 3406170 - protein, 18 aa, Plasmodium falciparum
KKGYLKYNFLDIYKQPVC

SEQ ID NO: 3406171 - protein, 19 aa, Plasmodium falciparum
KKHAKSMLKELIKVGLPSF

SEQ ID NO: 3406172 - protein, 27 aa, Plasmodium falciparum
KKIIELIRIFFPVNVLNYYPISNKGKA

SEQ ID NO: 3406173 - protein, 30 aa, Plasmodium falciparum
KKKDKLIFEIYKMYPGKILLTLKNIQKIND

SEQ ID NO: 3406174 - protein, 22 aa, Plasmodium falciparum
KKKKNILFIDEIHVIVGAGSGE

SEQ ID NO: 3406175 - protein, 25 aa, Plasmodium falciparum
KKKQLVYFLCELLSNIFGPNYKWRI

SEQ ID NO: 3406176 - protein, 23 aa, Plasmodium falciparum
KKKQYCIHSLRRALKNLKTNDMF

SEQ ID NO: 3406177 - protein, 34 aa, Plasmodium falciparum
KKKSEKVYDLYDYILNWVFGPMKITETNVSEQND

SEQ ID NO: 3406178 - protein, 23 aa, Plasmodium falciparum
KKKYLIESLKLLVRLHEAGLAHL

SEQ ID NO: 3406179 - protein, 24 aa, Plasmodium falciparum
KKLEYVFLSLYKYPENILNQKLED

SEQ ID NO: 3406180 - protein, 34 aa, Plasmodium falciparum
KKLYDPFIEKFIYPISKYWLKIDFNNLRSYWKYE

SEQ ID NO: 3406181 - protein, 32 aa, Plasmodium falciparum
KKNHEKYYLFKYLMLPLYPRDNQLTDGVVIKN

SEQ ID NO: 3406182 - protein, 30 aa, Plasmodium falciparum
KKNLDIPYSYILLTFEYFCDHTIILFEECV

SEQ ID NO: 3406183 - protein, 22 aa, Plasmodium falciparum
KKNMDKFRYLINDLEVLFGVYE

SEQ ID NO: 3406184 - protein, 42 aa, Plasmodium falciparum
KKNQVLLKIRLLLTFQSKGIPFIYLIKLWASARKHNIPNYFS

SEQ ID NO: 3406185 - protein, 28 aa, Plasmodium falciparum
KKPKSPVDLLRVLDIHKGDYGIPTLESK

SEQ ID NO: 3406186 - protein, 25 aa, Plasmodium falciparum
KKQYSYLLHIILSDLLEKYDSNLEI

SEQ ID NO: 3406187 - protein, 25 aa, Plasmodium falciparum
KKRKKFYDFIYLNNSFKTKYTKYIL

SEQ ID NO: 3406188 - protein, 23 aa, Plasmodium falciparum
KKSELMYPVFYAENLYIQKDGSN

SEQ ID NO: 3406189 - protein, 30 aa, Plasmodium falciparum
KKSSPLKIISVCTLLHLTDMLYKCSDENSN

SEQ ID NO: 3406190 - protein, 18 aa, Plasmodium falciparum
KKTKYIPNYILKHNYIYS

SEQ ID NO: 3406191 - protein, 25 aa, Plasmodium falciparum
KKTSPFYYKKLIKQSTYILKQLNIP

SEQ ID NO: 3406192 - protein, 25 aa, Plasmodium falciparum
KKYDKFIIYAPFVSLYNFLGKEGIH

SEQ ID NO: 3406193 - protein, 20 aa, Plasmodium falciparum
KKYINTLVPITYHRLNKNRT

SEQ ID NO: 3406194 - protein, 20 aa, Plasmodium falciparum
KKYLKLRKKFDGYITFAVVN

SEQ ID NO: 3406195 - protein, 23 aa, Plasmodium falciparum
KKYTLINYIITYIFNLIKNKVNI

SEQ ID NO: 3406196 - protein, 17 aa, Plasmodium falciparum
KLAILKNNLIICGGIQT

SEQ ID NO: 3406197 - protein, 25 aa, Plasmodium falciparum
KLFLFSILSFVVFLFILNYQTYASS

SEQ ID NO: 3406198 - protein, 23 aa, Plasmodium falciparum
KLNLKFHLDKFGILSLDKVLVVY

SEQ ID NO: 3406199 - protein, 22 aa, Plasmodium falciparum
KLNYELIYWNSKLKKERDRIYN

SEQ ID NO: 3406200 - protein, 22 aa, Plasmodium falciparum
KLQKAIIDWKYPATKYSISLSN

SEQ ID NO: 3406201 - protein, 27 aa, Plasmodium falciparum
KMKSAYIFDMIFQNIKYPFKGYNIGEN

SEQ ID NO: 3406202 - protein, 17 aa, Plasmodium falciparum
KMLKFNLNKLREVGYLK

SEQ ID NO: 3406203 - protein, 24 aa, Plasmodium falciparum
KMQDFYYNFQLYRNNYETTSATNI

SEQ ID NO: 3406204 - protein, 26 aa, Plasmodium falciparum
KMREGYLFVFFFYTKYHHEGVILPSN

SEQ ID NO: 3406205 - protein, 26 aa, Plasmodium falciparum
KMVEDKILFVYIGTFKEEIFKLSRSK

SEQ ID NO: 3406206 - protein, 18 aa, Plasmodium falciparum
KNARHKYFGIREVKLIGG

SEQ ID NO: 3406207 - protein, 28 aa, Plasmodium falciparum
KNDIINRQMFQLLRNSNNNNFICDTVTY

SEQ ID NO: 3406208 - protein, 22 aa, Plasmodium falciparum
KNESICVLSFLYLIGINDDNGK

SEQ ID NO: 3406209 - protein, 29 aa, Plasmodium falciparum
KNFKLVVYIKENTLILKWKVYGETKDTTE

SEQ ID NO: 3406210 - protein, 27 aa, Plasmodium falciparum
KNGKKEFFLFLLNIKKNSQQKKTYHIT

SEQ ID NO: 3406211 - protein, 21 aa, Plasmodium falciparum
KNIFYLGNIIKYNENIKLSKG

SEQ ID NO: 3406212 - protein, 21 aa, Plasmodium falciparum
KNIKDFFSFSIKLGKDKNINL

SEQ ID NO: 3406213 - protein, 23 aa, Plasmodium falciparum
KNIKNIFKIVLVKDFFLMYRENE

SEQ ID NO: 3406214 - protein, 25 aa, Plasmodium falciparum
KNIKNLHFLKTVYLFDIFLNEQSKK

SEQ ID NO: 3406215 - protein, 18 aa, Plasmodium falciparum
KNINAAVLYFRKYFEKYE

SEQ ID NO: 3406216 - protein, 20 aa, Plasmodium falciparum
KNINKYGLLFKNKANLGDDI

SEQ ID NO: 3406217 - protein, 17 aa, Plasmodium falciparum
KNKKKYMRTMWSELMFK

SEQ ID NO: 3406218 - protein, 28 aa, Plasmodium falciparum
KNKRAKFWLLDIYKFPSVLKYKEYKNCF

SEQ ID NO: 3406219 - protein, 24 aa, Plasmodium falciparum
KNKSISYLCPLPEFLIDVMRTTKY

SEQ ID NO: 3406220 - protein, 20 aa, Plasmodium falciparum
KNLSYFFIICDENNTYCVLE

SEQ ID NO: 3406221 - protein, 25 aa, Plasmodium falciparum
KNMIDNVFHYFFYVNMYDEKNKVVT

SEQ ID NO: 3406222 - protein, 17 aa, Plasmodium falciparum
KNPAFLPIQIKNPERHK

SEQ ID NO: 3406223 - protein, 23 aa, Plasmodium falciparum
KNPHYSFFLPSQKYILKIINNNV

SEQ ID NO: 3406224 - protein, 27 aa, Plasmodium falciparum
KNQLLFFRSIFLLQNKLNVIATNNINN

SEQ ID NO: 3406225 - protein, 24 aa, Plasmodium falciparum
KNSAIILCFPLSFSISRQSFFFFS

SEQ ID NO: 3406226 - protein, 18 aa, Plasmodium falciparum
KNSLLLFNLLTLEQSGTK

SEQ ID NO: 3406227 - protein, 21 aa, Plasmodium falciparum
KNVHIIFLYNEEYIDWNFNVK

SEQ ID NO: 3406228 - protein, 23 aa, Plasmodium falciparum
KNVKMLFQRIISDIPPPINTINS

SEQ ID NO: 3406229 - protein, 21 aa, Plasmodium falciparum
KNVQMLLDMVVKYLPSPIDSI

SEQ ID NO: 3406230 - protein, 31 aa, Plasmodium falciparum
KNVSIILSNIFRVLIYYSPNDLIPAVYITLN

SEQ ID NO: 3406231 - protein, 22 aa, Plasmodium falciparum
KNYFINTFSITWYNTIKPYMNN

SEQ ID NO: 3406232 - protein, 19 aa, Plasmodium falciparum
KPHKNIIKNIFRLKLVNGS

SEQ ID NO: 3406233 - protein, 17 aa, Plasmodium falciparum
KPIVVLLKNINKENSLE

SEQ ID NO: 3406234 - protein, 25 aa, Plasmodium falciparum
KPSITKFMFLSYNSSIDESLILCQP

SEQ ID NO: 3406235 - protein, 19 aa, Plasmodium falciparum
KPYSIILFDEIEKAHPDVY

SEQ ID NO: 3406236 - protein, 40 aa, Plasmodium falciparum
KQEVLNTLNFLFYVYNLFGFKYELFLSTRPKKFIGQISTW

SEQ ID NO: 3406237 - protein, 25 aa, Plasmodium falciparum
KQGKNTIYMIIAPKGSLHEKKTKEI

SEQ ID NO: 3406238 - protein, 26 aa, Plasmodium falciparum
KQIHVKGLFRLIKNKNVFKIKSADCK

SEQ ID NO: 3406239 - protein, 26 aa, Plasmodium falciparum
KQKNIHCYVLPYAKKNIYPCKTKVLK

SEQ ID NO: 3406240 - protein, 19 aa, Plasmodium falciparum
KQLLISSHKLLKTGKKLIV

SEQ ID NO: 3406241 - protein, 25 aa, Plasmodium falciparum
KQLNIPYRLVLLNSIETPYSASICY

SEQ ID NO: 3406242 - protein, 24 aa, Plasmodium falciparum
KQTYYKILLIKAYPQHLHGIQNNE

SEQ ID NO: 3406243 - protein, 20 aa, Plasmodium falciparum
KQYITYLYHSSICQYCSKVT

SEQ ID NO: 3406244 - protein, 24 aa, Plasmodium falciparum
KRKNYIFYELTYRCVPPKVCSFCG

SEQ ID NO: 3406245 - protein, 27 aa, Plasmodium falciparum
KRLKTSYIDLLQLHWPDRYYPDQSSGD

SEQ ID NO: 3406246 - protein, 18 aa, Plasmodium falciparum
KRNHRILDGLLRKGRKRK

SEQ ID NO: 3406247 - protein, 28 aa, Plasmodium falciparum
KRNYSFACPLGWIPSKKINYCKAPLNYK

SEQ ID NO: 3406248 - protein, 27 aa, Plasmodium falciparum
KRRKLRNNFFFLNNYRKMISLCNKIDI

SEQ ID NO: 3406249 - protein, 20 aa, Plasmodium falciparum
KRSFFPSGFNKNLNNLFLKN

SEQ ID NO: 3406250 - protein, 23 aa, Plasmodium falciparum
KRTKFIILNEPIVDLSFSENLFH

SEQ ID NO: 3406251 - protein, 31 aa, Plasmodium falciparum
KRTTKLCRHKFKLPIDFFKLGDQVRAKVVHV

SEQ ID NO: 3406252 - protein, 22 aa, Plasmodium falciparum
KSAFWDAFMCGYKVHIGNKPCP

SEQ ID NO: 3406253 - protein, 28 aa, Plasmodium falciparum
KSDHGFFKYGWDLLPTPIDLRYLDKKDP

SEQ ID NO: 3406254 - protein, 18 aa, Plasmodium falciparum
KSDSMFSGYFLEKESTEH

SEQ ID NO: 3406255 - protein, 32 aa, Plasmodium falciparum
KSENIYNILTLFSQNLFYPLFDEDFIENEVRE

SEQ ID NO: 3406256 - protein, 28 aa, Plasmodium falciparum
KSFLSYANFLILNRCLCDYRDGLKTVQR

SEQ ID NO: 3406257 - protein, 25 aa, Plasmodium falciparum
KSFTNFFAIILMKIKNFDLNSCNLY

SEQ ID NO: 3406258 - protein, 22 aa, Plasmodium falciparum
KSIMNYFLSFCMWLLNNQLKGH

SEQ ID NO: 3406259 - protein, 19 aa, Plasmodium falciparum
KSMLKELIKVGLPSFENLV

SEQ ID NO: 3406260 - protein, 30 aa, Plasmodium falciparum
KSNKNSMFLKFYLNNLYKYCNIKSIMVTNN

SEQ ID NO: 3406261 - protein, 24 aa, Plasmodium falciparum
KSSVYTFKHILKLLLEKKKSDNDK

SEQ ID NO: 3406262 - protein, 24 aa, Plasmodium falciparum
KSSYGYNIYFKRGLTHISKVKTDF

SEQ ID NO: 3406263 - protein, 28 aa, Plasmodium falciparum
KTAIIEYLSYLILKDNVPYHLKNCRIFQ

SEQ ID NO: 3406264 - protein, 21 aa, Plasmodium falciparum
KTAKRKIPSLYLFKNVNSYNK

SEQ ID NO: 3406265 - protein, 21 aa, Plasmodium falciparum
KTEFPLICTIYEISFQKKNPC

SEQ ID NO: 3406266 - protein, 47 aa, Plasmodium falciparum
KTKEDNYHLYYWDDFYHEYKPTYLNYHMHYTLYEPNNFYDTTNEETH

SEQ ID NO: 3406267 - protein, 27 aa, Plasmodium falciparum
KTKIRQPFFSYNFYLNKQGFLLNPYVQ

SEQ ID NO: 3406268 - protein, 24 aa, Plasmodium falciparum
KTKKHYWIHLPFKYNIIKISDDNT

SEQ ID NO: 3406269 - protein, 19 aa, Plasmodium falciparum
KTLDYLSFLPKNEDVTDTE

SEQ ID NO: 3406270 - protein, 25 aa, Plasmodium falciparum
KTLFLILYIIILQEYVCHSSNHIKS

SEQ ID NO: 3406271 - protein, 27 aa, Plasmodium falciparum
KTLINPHQFLIIIQAALESKIFVSEKI

SEQ ID NO: 3406272 - protein, 22 aa, Plasmodium falciparum
KTRNLLLKVAHLEKLSLIKSIN

SEQ ID NO: 3406273 - protein, 25 aa, Plasmodium falciparum
KTSDDRVLFLLPWENNTLVGTTDEK

SEQ ID NO: 3406274 - protein, 22 aa, Plasmodium falciparum
KTSPEFYHNLYYKTFNSNKEEK

SEQ ID NO: 3406275 - protein, 21 aa, Plasmodium falciparum
KTYDKYDGYILPNDVTKYDSN

SEQ ID NO: 3406276 - protein, 31 aa, Plasmodium falciparum
KVCVKYFSELRRKFFQIYRDPNNKNQNEDNV

SEQ ID NO: 3406277 - protein, 21 aa, Plasmodium falciparum
KVEDHWMNLWDNGKILHNKNE

SEQ ID NO: 3406278 - protein, 20 aa, Plasmodium falciparum
KVFNGLLNVILKWSQAFKNE

SEQ ID NO: 3406279 - protein, 24 aa, Plasmodium falciparum
KVIDILSKYLFKAITNIKDPNKPI

SEQ ID NO: 3406280 - protein, 24 aa, Plasmodium falciparum
KVKQTFLWPYSPPKIKRGNHLKSS

SEQ ID NO: 3406281 - protein, 32 aa, Plasmodium falciparum
KVNEIFIVHNYFMKPGLYYITVKDGKYILDDF

SEQ ID NO: 3406282 - protein, 25 aa, Plasmodium falciparum
KVREKIKMYTLFKDDKINTLKCNEE

SEQ ID NO: 3406283 - protein, 24 aa, Plasmodium falciparum
KVSDKYIPLIFNPTKDVFTSINQI

SEQ ID NO: 3406284 - protein, 20 aa, Plasmodium falciparum
KWNFEKWFNLDNPSIRVGPI

SEQ ID NO: 3406285 - protein, 20 aa, Plasmodium falciparum
KYCIGSTYFLRQVSIEDIAG

SEQ ID NO: 3406286 - protein, 22 aa, Plasmodium falciparum
KYDYVIIMGFTLMFPSTPFNPN

SEQ ID NO: 3406287 - protein, 19 aa, Plasmodium falciparum
KYEHTHILINAPKKVEFIY

SEQ ID NO: 3406288 - protein, 19 aa, Plasmodium falciparum
KYFGIREVKLIGGGNPYFL

SEQ ID NO: 3406289 - protein, 23 aa, Plasmodium falciparum
KYFQNFVDLSTYYDTLKKENLIL

SEQ ID NO: 3406290 - protein, 18 aa, Plasmodium falciparum
KYHFKEPWILNHGKTFNE

SEQ ID NO: 3406291 - protein, 26 aa, Plasmodium falciparum
KYIFNHIHFYSYILVYFNEGLLQHWT

SEQ ID NO: 3406292 - protein, 18 aa, Plasmodium falciparum
KYILLQYTNTFLSNSLLD

SEQ ID NO: 3406293 - protein, 19 aa, Plasmodium falciparum
KYKDMNFLCSLKKLKEYKT

SEQ ID NO: 3406294 - protein, 29 aa, Plasmodium falciparum
KYLEENIYFVIQSWLPDIRIDDTLILIDN

SEQ ID NO: 3406295 - protein, 19 aa, Plasmodium falciparum
KYNFKRSLLLKLGHQQTVL

SEQ ID NO: 3406296 - protein, 25 aa, Plasmodium falciparum
KYSQFIQFPIYLLHENVYTEEVLAD

SEQ ID NO: 3406297 - protein, 27 aa, Plasmodium falciparum
KYTSNQIRILFLLNKWDNFMNYSPNGE

SEQ ID NO: 3406298 - protein, 28 aa, Plasmodium falciparum
KYYSNVYILMFKVAYLFNNYDFYTFFYD

SEQ ID NO: 3406299 - protein, 20 aa, Plasmodium falciparum
KYYVNYGILMNLTKKGKKDL

SEQ ID NO: 3406300 - protein, 23 aa, Plasmodium falciparum
LADKIKYYLKFNNKILFDTTKDN

SEQ ID NO: 3406301 - protein, 26 aa, Plasmodium falciparum
LAKLQGIPLNVYFPYSATEETCPYNI

SEQ ID NO: 3406302 - protein, 24 aa, Plasmodium falciparum
LASFLKTFICYSPKNVITVSPPRN

SEQ ID NO: 3406303 - protein, 25 aa, Plasmodium falciparum
LASFLKTFICYSPKNVITVSPPRNN

SEQ ID NO: 3406304 - protein, 17 aa, Plasmodium falciparum
LAVLAKGFLRNKEHANL

SEQ ID NO: 3406305 - protein, 29 aa, Plasmodium falciparum
LCLFFIYLYIYKTYGKVKNTDEGLSNIYG

SEQ ID NO: 3406306 - protein, 17 aa, Plasmodium falciparum
LCNFFNNYLFRESIFNL

SEQ ID NO: 3406307 - protein, 25 aa, Plasmodium falciparum
LCRKNELPYLKKLIILDNLTKRSEM

SEQ ID NO: 3406308 - protein, 25 aa, Plasmodium falciparum
LDDINILYILLFNTLMIYKKKYDFF

SEQ ID NO: 3406309 - protein, 17 aa, Plasmodium falciparum
LDIITFFQKNQNIEQIQ

SEQ ID NO: 3406310 - protein, 35 aa, Plasmodium falciparum
LDIYIDYIFQPYTIYNIPIYITPNNLKYILLQYTN

SEQ ID NO: 3406311 - protein, 18 aa, Plasmodium falciparum
LDLFLFNQTSFLEKGNNI

SEQ ID NO: 3406312 - protein, 17 aa, Plasmodium falciparum
LDLGIPSVFSVFSLSKE

SEQ ID NO: 3406313 - protein, 21 aa, Plasmodium falciparum
LDLYDVTWYAGKIDIFVKVEE

SEQ ID NO: 3406314 - protein, 25 aa, Plasmodium falciparum
LEEKMEALLYILKNEKTKKKVIVCS

SEQ ID NO: 3406315 - protein, 28 aa, Plasmodium falciparum
LEIDDEIVILPFFELVVSSLPKKNILIC

SEQ ID NO: 3406316 - protein, 20 aa, Plasmodium falciparum
LELPHNILTYHYPSFTYIDR

SEQ ID NO: 3406317 - protein, 24 aa, Plasmodium falciparum
LENKTYFSILIYNGPMQLTNHLYD

SEQ ID NO: 3406318 - protein, 19 aa, Plasmodium falciparum
LERECNIFWPCLDNCEKDY

SEQ ID NO: 3406319 - protein, 17 aa, Plasmodium falciparum
LEWICVDLDLVEGILER

SEQ ID NO: 3406320 - protein, 17 aa, Plasmodium falciparum
LFCKSVLNFKLKQNVSN

SEQ ID NO: 3406321 - protein, 17 aa, Plasmodium falciparum
LFCTVCCFSKKDIFNPK

SEQ ID NO: 3406322 - protein, 25 aa, Plasmodium falciparum
LFESDEIIKFYKKLLQKVSNDDKSS

SEQ ID NO: 3406323 - protein, 18 aa, Plasmodium falciparum
LFFEKYDIYFMKAELHKD

SEQ ID NO: 3406324 - protein, 18 aa, Plasmodium falciparum
LFFFFKVIDRVICVTPQK

SEQ ID NO: 3406325 - protein, 19 aa, Plasmodium falciparum
LFFFLIKIYRVNGVHIKGR

SEQ ID NO: 3406326 - protein, 17 aa, Plasmodium falciparum
LFFFNFMIFQGKVILCV

SEQ ID NO: 3406327 - protein, 18 aa, Plasmodium falciparum
LFFYYNNFIYVDTINTSI

SEQ ID NO: 3406328 - protein, 20 aa, Plasmodium falciparum
LFGTILIFLNKKNNVKNIKL

SEQ ID NO: 3406329 - protein, 17 aa, Plasmodium falciparum
LFHIIKGPDFSTGGIII

SEQ ID NO: 3406330 - protein, 20 aa, Plasmodium falciparum
LFICFFVFFVHAVSSQEQPN

SEQ ID NO: 3406331 - protein, 18 aa, Plasmodium falciparum
LFIIYIIHVYPCKSGCLG

SEQ ID NO: 3406332 - protein, 25 aa, Plasmodium falciparum
LFIWYFFFVYVKNLSILQYDKAKVL

SEQ ID NO: 3406333 - protein, 25 aa, Plasmodium falciparum
LFKVRKYFHNFILSNNYFSKKKSKQ

SEQ ID NO: 3406334 - protein, 30 aa, Plasmodium falciparum
LFLAVFFVLTIFKKLLKWEIFIEAWYTQEE

SEQ ID NO: 3406335 - protein, 22 aa, Plasmodium falciparum
LFLFIQLYITLNKARVTENTIC

SEQ ID NO: 3406336 - protein, 22 aa, Plasmodium falciparum
LFLFLHFYTIVCFIQNNTQKTF

SEQ ID NO: 3406337 - protein, 21 aa, Plasmodium falciparum
LFLFLISFVFESFVRSHGDLF

SEQ ID NO: 3406338 - protein, 21 aa, Plasmodium falciparum
LFLFQVVYSRRAFINVHKNNI

SEQ ID NO: 3406339 - protein, 18 aa, Plasmodium falciparum
LFLIFLCLNNVVIGNKCK

SEQ ID NO: 3406340 - protein, 29 aa, Plasmodium falciparum
LFLILLNLYKCASISCEIDYTPSTNITSN

SEQ ID NO: 3406341 - protein, 18 aa, Plasmodium falciparum
LFLLNVIIYETNIILNDK

SEQ ID NO: 3406342 - protein, 18 aa, Plasmodium falciparum
LFLYKTYDIYKNKKEPYP

SEQ ID NO: 3406343 - protein, 18 aa, Plasmodium falciparum
LFLYSGSICAIHLWRHSE

SEQ ID NO: 3406344 - protein, 18 aa, Plasmodium falciparum
LFLYSVVAVRPYKERYGN

SEQ ID NO: 3406345 - protein, 20 aa, Plasmodium falciparum
LFLYVILPENNVQKTSLKKQ

SEQ ID NO: 3406346 - protein, 22 aa, Plasmodium falciparum
LFMLLFYSHVKIKKLFIKISNV

SEQ ID NO: 3406347 - protein, 26 aa, Plasmodium falciparum
LFNNYDFYTFFYDLTGIRLIDSNVIS

SEQ ID NO: 3406348 - protein, 17 aa, Plasmodium falciparum
LFPLIMLLTHNIKIQSL

SEQ ID NO: 3406349 - protein, 29 aa, Plasmodium falciparum
LFQPIFKQIKELFPYLPNYEGKINEQDVD

SEQ ID NO: 3406350 - protein, 18 aa, Plasmodium falciparum
LFRKSVVSVIGVLVALLN

SEQ ID NO: 3406351 - protein, 18 aa, Plasmodium falciparum
LFSFINFFFVYDVTCTKE

SEQ ID NO: 3406352 - protein, 20 aa, Plasmodium falciparum
LFTILFWLSLVSGENVNNKN

SEQ ID NO: 3406353 - protein, 26 aa, Plasmodium falciparum
LFVFVLYLVSAFIKRQWVPNNYIYFK

SEQ ID NO: 3406354 - protein, 20 aa, Plasmodium falciparum
LFVLLLQDIIIWKNINVKCY

SEQ ID NO: 3406355 - protein, 17 aa, Plasmodium falciparum
LFVLTTCFVKGDLPIHA

SEQ ID NO: 3406356 - protein, 19 aa, Plasmodium falciparum
LGFESWRFVKYPYGNLIES

SEQ ID NO: 3406357 - protein, 23 aa, Plasmodium falciparum
LGGLYLNFFLSRVVSKKWKQKHL

SEQ ID NO: 3406358 - protein, 24 aa, Plasmodium falciparum
LGRTTLNYPLYFNKKSITLKQYKH

SEQ ID NO: 3406359 - protein, 27 aa, Plasmodium falciparum
LGSFFFPEMKRAPYQLPYLVGHYDSRS

SEQ ID NO: 3406360 - protein, 17 aa, Plasmodium falciparum
LGYKRFMIYSENTFVIS

SEQ ID NO: 3406361 - protein, 18 aa, Plasmodium falciparum
LHFPYGFPRNIDFSVKLI

SEQ ID NO: 3406362 - protein, 20 aa, Plasmodium falciparum
LIDFPLRRGIRDFDDFYSIL

SEQ ID NO: 3406363 - protein, 19 aa, Plasmodium falciparum
LIEIIPFNNIINSLDYIFL

SEQ ID NO: 3406364 - protein, 24 aa, Plasmodium falciparum
LIFLYFCLYLNIKESIILGNCKII

SEQ ID NO: 3406365 - protein, 17 aa, Plasmodium falciparum
LIFVYNIKELIYKENLA

SEQ ID NO: 3406366 - protein, 19 aa, Plasmodium falciparum
LIIFSFLSGSLTIGLKGMK

SEQ ID NO: 3406367 - protein, 20 aa, Plasmodium falciparum
LIIILIKKTSAIDLIEGIFY

SEQ ID NO: 3406368 - protein, 17 aa, Plasmodium falciparum
LIILILLSILSRTVDSG

SEQ ID NO: 3406369 - protein, 21 aa, Plasmodium falciparum
LIIWAINIKRYINYNIKIKLK

SEQ ID NO: 3406370 - protein, 18 aa, Plasmodium falciparum
LIIYFHLIVCIKVDIERK

SEQ ID NO: 3406371 - protein, 17 aa, Plasmodium falciparum
LIKANISTYYKATAQRI

SEQ ID NO: 3406372 - protein, 20 aa, Plasmodium falciparum
LILCVLFCKNDIKCTTVDES

SEQ ID NO: 3406373 - protein, 21 aa, Plasmodium falciparum
LILYIVFFKNTIKSETTTDES

SEQ ID NO: 3406374 - protein, 21 aa, Plasmodium falciparum
LINILFLNFIKCDIPVHCLSR

SEQ ID NO: 3406375 - protein, 19 aa, Plasmodium falciparum
LINIRYRSHLKKNYFAFKR

SEQ ID NO: 3406376 - protein, 17 aa, Plasmodium falciparum
LINLCRIKYNKPVIVAT

SEQ ID NO: 3406377 - protein, 18 aa, Plasmodium falciparum
LIPFHIKTKERLPLNFIK

SEQ ID NO: 3406378 - protein, 24 aa, Plasmodium falciparum
LIQFIIYIYFFKTVVKSLNLKIDL

SEQ ID NO: 3406379 - protein, 21 aa, Plasmodium falciparum
LIVCTIINYYCAVQNNGNKSL

SEQ ID NO: 3406380 - protein, 17 aa, Plasmodium falciparum
LIVLLNVCFSYLIKKKN

SEQ ID NO: 3406381 - protein, 19 aa, Plasmodium falciparum
LIVLLYVIQIFVIKSKKIF

SEQ ID NO: 3406382 - protein, 21 aa, Plasmodium falciparum
LIYYIYFSNVIKIRKNDISII

SEQ ID NO: 3406383 - protein, 25 aa, Plasmodium falciparum
LKASPDFYHNLYYKNFDSQKGKADQ

SEQ ID NO: 3406384 - protein, 26 aa, Plasmodium falciparum
LKASPEFYHNLYFKNFNVGKKNLFSE

SEQ ID NO: 3406385 - protein, 27 aa, Plasmodium falciparum
LKEYKNFTFPIDYIKELILKKKFSKHK

SEQ ID NO: 3406386 - protein, 36 aa, Plasmodium falciparum
LKGDIQYLPLSYYYDSIIYFKVIFATSKYGYHEIVP

SEQ ID NO: 3406387 - protein, 20 aa, Plasmodium falciparum
LKGLNFYDFDFNISVLSRGT

SEQ ID NO: 3406388 - protein, 18 aa, Plasmodium falciparum
LKKENVFYDFQWGKDFSF

SEQ ID NO: 3406389 - protein, 25 aa, Plasmodium falciparum
LKKKTSFYLVYNKCPLYYKNLCFKE

SEQ ID NO: 3406390 - protein, 17 aa, Plasmodium falciparum
LKKLKNRLYIYPCSYDN

SEQ ID NO: 3406391 - protein, 27 aa, Plasmodium falciparum
LKNFFSELWQNIRFLFKSKLKIRDMEY

SEQ ID NO: 3406392 - protein, 21 aa, Plasmodium falciparum
LKNRLYIYPCSYDNQIGRMNL

SEQ ID NO: 3406393 - protein, 23 aa, Plasmodium falciparum
LKNYKIIFVTKNGFGKMINLNEL

SEQ ID NO: 3406394 - protein, 18 aa, Plasmodium falciparum
LKPMLARGELRCIGATTV

SEQ ID NO: 3406395 - protein, 21 aa, Plasmodium falciparum
LKQVSFLLYDWFRKNDVKDNT

SEQ ID NO: 3406396 - protein, 25 aa, Plasmodium falciparum
LKRTQLEWLCIDLDLVEGLLCHIKE

SEQ ID NO: 3406397 - protein, 18 aa, Plasmodium falciparum
LKSFLKHFTVFFYLFKVD

SEQ ID NO: 3406398 - protein, 26 aa, Plasmodium falciparum
LKSMRAVSLSSLQKLILEHNKILREK

SEQ ID NO: 3406399 - protein, 23 aa, Plasmodium falciparum
LKTITPWISFFNMYGTHVISGVY

SEQ ID NO: 3406400 - protein, 31 aa, Plasmodium falciparum
LKTSVLNKLKDLLLRLLYKAYVSYKKRKAQE

SEQ ID NO: 3406401 - protein, 29 aa, Plasmodium falciparum
LKTTEFTIVFWIYLLERSTSHFRNIISQI

SEQ ID NO: 3406402 - protein, 20 aa, Plasmodium falciparum
LKVLGIINKYSPKGGFSISV

SEQ ID NO: 3406403 - protein, 24 aa, Plasmodium falciparum
LKYNNIIDLILYNTIIDIKENSFV

SEQ ID NO: 3406404 - protein, 25 aa, Plasmodium falciparum
LLCFICVIFLLHKNVVRSGDNMKYN

SEQ ID NO: 3406405 - protein, 23 aa, Plasmodium falciparum
LLCVKYFLIYSKAYKKKNNNDVI

SEQ ID NO: 3406406 - protein, 20 aa, Plasmodium falciparum
LLEYYLLQNKIFKNKNFLSF

SEQ ID NO: 3406407 - protein, 19 aa, Plasmodium falciparum
LLFCPMAYAYEFIYHLNVF

SEQ ID NO: 3406408 - protein, 20 aa, Plasmodium falciparum
LLFFVFISYIYVNGQFCKFN

SEQ ID NO: 3406409 - protein, 21 aa, Plasmodium falciparum
LLFIFLINTLLLSHYENYINN

SEQ ID NO: 3406410 - protein, 24 aa, Plasmodium falciparum
LLFIIYIYNSLRIKCSSLLGIDFG

SEQ ID NO: 3406411 - protein, 20 aa, Plasmodium falciparum
LLFILLYSSDIIISINPSTL

SEQ ID NO: 3406412 - protein, 18 aa, Plasmodium falciparum
LLFSVINNLSICFRIYGG

SEQ ID NO: 3406413 - protein, 23 aa, Plasmodium falciparum
LLFTVQGLLASLTCGLCCYLYSY

SEQ ID NO: 3406414 - protein, 21 aa, Plasmodium falciparum
LLFVLFFENLVVSIKYRNIHY

SEQ ID NO: 3406415 - protein, 27 aa, Plasmodium falciparum
LLIICSVFFFVYGFNNKFVYSSYLKDD

SEQ ID NO: 3406416 - protein, 21 aa, Plasmodium falciparum
LLIILFPYHVNSRKPIKYKNV

SEQ ID NO: 3406417 - protein, 18 aa, Plasmodium falciparum
LLKLLLVGDSSVGKSSIL

SEQ ID NO: 3406418 - protein, 18 aa, Plasmodium falciparum
LLKTILSDNFCRWKKLPN

SEQ ID NO: 3406419 - protein, 17 aa, Plasmodium falciparum
LLLINFGTKVYGDDNGE

SEQ ID NO: 3406420 - protein, 22 aa, Plasmodium falciparum
LLLIVSLLKFISAVDSNIEGPV

SEQ ID NO: 3406421 - protein, 17 aa, Plasmodium falciparum
LLLNMIHSFVIKKLKWE

SEQ ID NO: 3406422 - protein, 26 aa, Plasmodium falciparum
LLLPVYFLFFWIHLNIVRSDNVCKGA

SEQ ID NO: 3406423 - protein, 23 aa, Plasmodium falciparum
LLLVIFLLCLRYGYSIKKKRSPN

SEQ ID NO: 3406424 - protein, 17 aa, Plasmodium falciparum
LLNQLIIFQDKFNYIKM

SEQ ID NO: 3406425 - protein, 24 aa, Plasmodium falciparum
LLNVCFSYLIKKKNIIINNNDNFY

SEQ ID NO: 3406426 - protein, 19 aa, Plasmodium falciparum
LLQTRLAYPLIYPFNTTAL

SEQ ID NO: 3406427 - protein, 23 aa, Plasmodium falciparum
LLRPIKRLHFYLLNKKINLHSIT

SEQ ID NO: 3406428 - protein, 19 aa, Plasmodium falciparum
LLSIFSFNLYGLELNEKVS

SEQ ID NO: 3406429 - protein, 22 aa, Plasmodium falciparum
LLSYFNVFYPISTCMCYSIRSK

SEQ ID NO: 3406430 - protein, 22 aa, Plasmodium falciparum
LLTLLLTLAYGKGVRNKSENRT

SEQ ID NO: 3406431 - protein, 19 aa, Plasmodium falciparum
LLVFYLCGYCLSRMFRFNF

SEQ ID NO: 3406432 - protein, 18 aa, Plasmodium falciparum
LLVNIYSRIFCHLQNIKH

SEQ ID NO: 3406433 - protein, 25 aa, Plasmodium falciparum
LLWYYLCSVQFIWGDIKLVNSDFGE

SEQ ID NO: 3406434 - protein, 21 aa, Plasmodium falciparum
LLYIISLFLNNLNTLCNSLKS

SEQ ID NO: 3406435 - protein, 23 aa, Plasmodium falciparum
LNAFSPIFILFSDKLDLDLLKQY

SEQ ID NO: 3406436 - protein, 19 aa, Plasmodium falciparum
LNALTAIKYGFSDMGDIIK

SEQ ID NO: 3406437 - protein, 18 aa, Plasmodium falciparum
LNELKYYLDLLEEKKKEN

SEQ ID NO: 3406438 - protein, 17 aa, Plasmodium falciparum
LNGSKYFAFFKYERKSN

SEQ ID NO: 3406439 - protein, 17 aa, Plasmodium falciparum
LNINFLFTKDNILDINK

SEQ ID NO: 3406440 - protein, 19 aa, Plasmodium falciparum
LNLLSQNKLYLLIQSIRNK

SEQ ID NO: 3406441 - protein, 28 aa, Plasmodium falciparum
LNLYYPEAIYLYRITLSGYMFCNYTEKI

SEQ ID NO: 3406442 - protein, 29 aa, Plasmodium falciparum
LNMKGKMVLQYLVHLKFLTQEKKNQLKEI

SEQ ID NO: 3406443 - protein, 18 aa, Plasmodium falciparum
LNMLFYSTNCEQSEILPL

SEQ ID NO: 3406444 - protein, 25 aa, Plasmodium falciparum
LNNTKLEWLCLDLDLVEGLLCRKNE

SEQ ID NO: 3406445 - protein, 29 aa, Plasmodium falciparum
LNRQRQNFNNFLSFLSENYQSYEKFYKSQ

SEQ ID NO: 3406446 - protein, 19 aa, Plasmodium falciparum
LNRYNIINDIYLTSKTWDM

SEQ ID NO: 3406447 - protein, 24 aa, Plasmodium falciparum
LNRYNIINHIYLTSKIWDTNNYLT

SEQ ID NO: 3406448 - protein, 18 aa, Plasmodium falciparum
LPISHVFERTFAYSILMY

SEQ ID NO: 3406449 - protein, 19 aa, Plasmodium falciparum
LPISHVFERTFAYSILMYG

SEQ ID NO: 3406450 - protein, 31 aa, Plasmodium falciparum
LPNEKYIRSLSNFTFIVYFTLNGGEGTWRTI

SEQ ID NO: 3406451 - protein, 24 aa, Plasmodium falciparum
LPTPTTFLLFVQPSDLRSGDTCKG

SEQ ID NO: 3406452 - protein, 24 aa, Plasmodium falciparum
LQGSLNKYYLSLLKANVLTKKDAE

SEQ ID NO: 3406453 - protein, 19 aa, Plasmodium falciparum
LQPLPMFVYNYENIVSASD

SEQ ID NO: 3406454 - protein, 19 aa, Plasmodium falciparum
LRFDFSFIENINIDAITKI

SEQ ID NO: 3406455 - protein, 18 aa, Plasmodium falciparum
LRIHFFDLWEDDSLFLQV

SEQ ID NO: 3406456 - protein, 23 aa, Plasmodium falciparum
LRISEFLHCYYKPISYYQIKLEE

SEQ ID NO: 3406457 - protein, 23 aa, Plasmodium falciparum
LRKHTLFLEQNYLNKTIPSVKIS

SEQ ID NO: 3406458 - protein, 23 aa, Plasmodium falciparum
LRSNLLPALSPMKGLKLLLSLND

SEQ ID NO: 3406459 - protein, 26 aa, Plasmodium falciparum
LSANCIFFKIFTIVIFCILQCASHIE

SEQ ID NO: 3406460 - protein, 23 aa, Plasmodium falciparum
LSDFLKCYKKYLALSIFGYETDT

SEQ ID NO: 3406461 - protein, 25 aa, Plasmodium falciparum
LSDRYISYRFLPDKAIDLIDEAASN

SEQ ID NO: 3406462 - protein, 23 aa, Plasmodium falciparum
LSEPSTYKLIYKEYRKFLKSGCY

SEQ ID NO: 3406463 - protein, 17 aa, Plasmodium falciparum
LSFLSSYIIAFSFKSTQ

SEQ ID NO: 3406464 - protein, 31 aa, Plasmodium falciparum
LSGNPLMRNIWPLIYRNVKVNAILYIINIMD

SEQ ID NO: 3406465 - protein, 23 aa, Plasmodium falciparum
LSIDTLKKFLIGFSVMEFQSFES

SEQ ID NO: 3406466 - protein, 18 aa, Plasmodium falciparum
LSIFESSNLKYLWRIPII

SEQ ID NO: 3406467 - protein, 18 aa, Plasmodium falciparum
LSIFFCFVTNISLEFKRK

SEQ ID NO: 3406468 - protein, 22 aa, Plasmodium falciparum
LSLFIFFVKGVILVVQAGKGNY

SEQ ID NO: 3406469 - protein, 24 aa, Plasmodium falciparum
LSLFLLHLYIYINNVASKEIVKKY

SEQ ID NO: 3406470 - protein, 18 aa, Plasmodium falciparum
LSMFFFENKTYCFISKIN

SEQ ID NO: 3406471 - protein, 29 aa, Plasmodium falciparum
LSMLSKTIKIPLASIKKYFIIHENKEYNS

SEQ ID NO: 3406472 - protein, 43 aa, Plasmodium falciparum
LSRPVSILMPIYKYWQVPYFSYNIKIYDLLADLVCYFDKGVPN

SEQ ID NO: 3406473 - protein, 24 aa, Plasmodium falciparum
LSTLKHEYFFDKLPSIIVKEKDAS

SEQ ID NO: 3406474 - protein, 21 aa, Plasmodium falciparum
LSVGIAFAALSSFLLKKKPKS

SEQ ID NO: 3406475 - protein, 19 aa, Plasmodium falciparum
LSVIILNVIQKGCCSSWLN

SEQ ID NO: 3406476 - protein, 18 aa, Plasmodium falciparum
LSVVFLLIYDTTNCVKRS

SEQ ID NO: 3406477 - protein, 17 aa, Plasmodium falciparum
LSYIIFNKESTKLKFSC

SEQ ID NO: 3406478 - protein, 26 aa, Plasmodium falciparum
LSYKKVIQILKDSIVYLPSLKNMVAW

SEQ ID NO: 3406479 - protein, 20 aa, Plasmodium falciparum
LSYLLRRKNGTKHPVYPTAP

SEQ ID NO: 3406480 - protein, 17 aa, Plasmodium falciparum
LTFGFPTVIALSLSKNV

SEQ ID NO: 3406481 - protein, 31 aa, Plasmodium falciparum
LTFIIFTVLLILILPSYCFIIKDSKIINDTW

SEQ ID NO: 3406482 - protein, 25 aa, Plasmodium falciparum
LTMLQYNFFHVIGKNYLKLYGSLYD

SEQ ID NO: 3406483 - protein, 26 aa, Plasmodium falciparum
LTPTLKVKRFYVFKDYNFFIEEVKKT

SEQ ID NO: 3406484 - protein, 26 aa, Plasmodium falciparum
LTSVMSFFAPLLSFYKNYQNYQDFEE

SEQ ID NO: 3406485 - protein, 26 aa, Plasmodium falciparum
LVDKSNFFMGMRPWRFVAIVENNILV

SEQ ID NO: 3406486 - protein, 20 aa, Plasmodium falciparum
LVIFFLFHKYALCAEEHEIT

SEQ ID NO: 3406487 - protein, 17 aa, Plasmodium falciparum
LVKYWIIRNTWGKNWGY

SEQ ID NO: 3406488 - protein, 27 aa, Plasmodium falciparum
LVLSFYQIICFFLAHYNPYFTTNIVKC

SEQ ID NO: 3406489 - protein, 17 aa, Plasmodium falciparum
LVRKILSLRKSDHNGPF

SEQ ID NO: 3406490 - protein, 17 aa, Plasmodium falciparum
LVTLNLFHISLEHNVEE

SEQ ID NO: 3406491 - protein, 19 aa, Plasmodium falciparum
LVVSLLIWKLSYSNDTRQL

SEQ ID NO: 3406492 - protein, 26 aa, Plasmodium falciparum
LYDFEVEFFILTFNRFTSKFHKMNSN

SEQ ID NO: 3406493 - protein, 26 aa, Plasmodium falciparum
LYDQINKKYFFLELNPRLQVEHPVSE

SEQ ID NO: 3406494 - protein, 30 aa, Plasmodium falciparum
LYEKLTWIYDNIYMIKRYYTAYALEGVCSY

SEQ ID NO: 3406495 - protein, 22 aa, Plasmodium falciparum
LYFLLVHLSLCIRYRNQNKTDS

SEQ ID NO: 3406496 - protein, 21 aa, Plasmodium falciparum
LYGIPRMYKWLTSYYPTVREE

SEQ ID NO: 3406497 - protein, 33 aa, Plasmodium falciparum
LYGQIYDRNILKKQFYFFLYHDDINTCYRILNE

SEQ ID NO: 3406498 - protein, 19 aa, Plasmodium falciparum
LYHFFLKYYVEKKELIQLT

SEQ ID NO: 3406499 - protein, 17 aa, Plasmodium falciparum
LYHINLPIFVNNSSISI

SEQ ID NO: 3406500 - protein, 30 aa, Plasmodium falciparum
LYKKVYAMRDYFYKIFYDHYNPNLDIYELE

SEQ ID NO: 3406501 - protein, 17 aa, Plasmodium falciparum
LYNHTINSLKKGWSLPI

SEQ ID NO: 3406502 - protein, 17 aa, Plasmodium falciparum
LYVFVLRNIFKDDTFSV

SEQ ID NO: 3406503 - protein, 17 aa, Plasmodium falciparum
LYYLSFTKKSELMYPVF

SEQ ID NO: 3406504 - protein, 17 aa, Plasmodium falciparum
MDIFISILQNIPKEYIT

SEQ ID NO: 3406505 - protein, 26 aa, Plasmodium falciparum
MFKEKLNLFFLIKHLEIFYKNLMADY

SEQ ID NO: 3406506 - protein, 21 aa, Plasmodium falciparum
MFRILFELYAQYNKISNEKML

SEQ ID NO: 3406507 - protein, 18 aa, Plasmodium falciparum
MHRKIVLSIFYMIADMNK

SEQ ID NO: 3406508 - protein, 19 aa, Plasmodium falciparum
MIEFSYIYNQIIWKINNSK

SEQ ID NO: 3406509 - protein, 25 aa, Plasmodium falciparum
MINRLPNVYILNTIEYILTDPKTSS

SEQ ID NO: 3406510 - protein, 24 aa, Plasmodium falciparum
MKDDHTIEFFLKKKIPLGHYKMQV

SEQ ID NO: 3406511 - protein, 23 aa, Plasmodium falciparum
MKEKYLSAILVLSPYKFSSVEEV

SEQ ID NO: 3406512 - protein, 18 aa, Plasmodium falciparum
MKTFFTQNIYKKNNIYPC

SEQ ID NO: 3406513 - protein, 26 aa, Plasmodium falciparum
MNDQIIFLFEMPLSEILINFLDQIKS

SEQ ID NO: 3406514 - protein, 26 aa, Plasmodium falciparum
MNFNKIWTTLFWPKKLKRILRQLLDL

SEQ ID NO: 3406515 - protein, 22 aa, Plasmodium falciparum
MPEQIINSLYLYSTIYEKVCYT

SEQ ID NO: 3406516 - protein, 26 aa, Plasmodium falciparum
MQNDYFKNFCNITSLVYDIEKLKKNN

SEQ ID NO: 3406517 - protein, 18 aa, Plasmodium falciparum
MRITEFKNYIRFPYKYKP

SEQ ID NO: 3406518 - protein, 22 aa, Plasmodium falciparum
MRTIFPLPRLTIQSVFHELKSI

SEQ ID NO: 3406519 - protein, 24 aa, Plasmodium falciparum
MSAPLIMTIILNFFKKYMAENKFN

SEQ ID NO: 3406520 - protein, 29 aa, Plasmodium falciparum
MTNIDLFVNIYLPRNILIKKLLGRRICNI

SEQ ID NO: 3406521 - protein, 17 aa, Plasmodium falciparum
MTNLFRYIGPNTDVPAG

SEQ ID NO: 3406522 - protein, 21 aa, Plasmodium falciparum
MYHMSQWNVLLIKKKILCCSN

SEQ ID NO: 3406523 - protein, 23 aa, Plasmodium falciparum
MYKKNNCKKYFLNSHYNNYLCKK

SEQ ID NO: 3406524 - protein, 17 aa, Plasmodium falciparum
NALYYLSFTKKSELMYP

SEQ ID NO: 3406525 - protein, 17 aa, Plasmodium falciparum
NARNYLMNVRKLSIDTL

SEQ ID NO: 3406526 - protein, 26 aa, Plasmodium falciparum
NCENVSLWMKFFDIYGTHIIYESQLG

SEQ ID NO: 3406527 - protein, 25 aa, Plasmodium falciparum
NCNFKRLYDYIFYKHKINAYHKYRI

SEQ ID NO: 3406528 - protein, 19 aa, Plasmodium falciparum
NCPYYKENYLNNLMSYDII

SEQ ID NO: 3406529 - protein, 24 aa, Plasmodium falciparum
NCVKYTIGLPPYIPWDKTTAYKNA

SEQ ID NO: 3406530 - protein, 24 aa, Plasmodium falciparum
NDDTVYIKSLQNKPLLKMNNKEKN

SEQ ID NO: 3406531 - protein, 27 aa, Plasmodium falciparum
NDELRNVFIHCYYFAKPEFFYEHAEKN

SEQ ID NO: 3406532 - protein, 26 aa, Plasmodium falciparum
NDFSGGEFLWPGYTEELKAKKASEDA

SEQ ID NO: 3406533 - protein, 23 aa, Plasmodium falciparum
NDGRSSWQLLPNNQLKILRNGNF

SEQ ID NO: 3406534 - protein, 24 aa, Plasmodium falciparum
NDIDPYIPYIYKDIAPVLKEYADD

SEQ ID NO: 3406535 - protein, 25 aa, Plasmodium falciparum
NDIYVLKSWFKSMDIKKIKYISDGN

SEQ ID NO: 3406536 - protein, 30 aa, Plasmodium falciparum
NDLLKNKQLLKEAISKLTLDPSMMNMLNNK

SEQ ID NO: 3406537 - protein, 30 aa, Plasmodium falciparum
NDNENEILLKHLLIAIIRIDSNLVQNILKN

SEQ ID NO: 3406538 - protein, 35 aa, Plasmodium falciparum
NDQELINHFLKSEKFKRALKFYNVNTKYVTIPLIY

SEQ ID NO: 3406539 - protein, 23 aa, Plasmodium falciparum
NDQELRAMLFGLNYDPSKRNKNN

SEQ ID NO: 3406540 - protein, 23 aa, Plasmodium falciparum
NECRHIVPLKAQKLIPGLTKIFE

SEQ ID NO: 3406541 - protein, 26 aa, Plasmodium falciparum
NEDEKSFFNIKNDLNYILSKNLNMNI

SEQ ID NO: 3406542 - protein, 18 aa, Plasmodium falciparum
NEIDIFNNLIRLLKAHPG

SEQ ID NO: 3406543 - protein, 24 aa, Plasmodium falciparum
NEIKKKFYLYIHPSKMPEAKPNND

SEQ ID NO: 3406544 - protein, 17 aa, Plasmodium falciparum
NEIRRAIQILSRRTKNN

SEQ ID NO: 3406545 - protein, 24 aa, Plasmodium falciparum
NEKIYIHKFGMFYNIFRKKRCIKN

SEQ ID NO: 3406546 - protein, 36 aa, Plasmodium falciparum
NEKTNEYYFVIYYCNWKYECMALYNAFHNILNNNYN

SEQ ID NO: 3406547 - protein, 31 aa, Plasmodium falciparum
NELCKSEKYKFLYLIYDLRKLYEELIDDIDD

SEQ ID NO: 3406548 - protein, 18 aa, Plasmodium falciparum
NERRYGYFDLLEKKNEKI

SEQ ID NO: 3406549 - protein, 25 aa, Plasmodium falciparum
NETKLEWLCLDLDLVDGLLLHRHEL

SEQ ID NO: 3406550 - protein, 20 aa, Plasmodium falciparum
NEYFFSPFNLPSLGEKKKRR

SEQ ID NO: 3406551 - protein, 25 aa, Plasmodium falciparum
NEYNNTILFFIFKDLGTANNNINNI

SEQ ID NO: 3406552 - protein, 27 aa, Plasmodium falciparum
NEYSNLCFKIILLIIKRLRNDIILDNV

SEQ ID NO: 3406553 - protein, 20 aa, Plasmodium falciparum
NEYVLHIGVFLKGYVSKNDK

SEQ ID NO: 3406554 - protein, 22 aa, Plasmodium falciparum
NFDRGIINPYLLYNENKDYIEY

SEQ ID NO: 3406555 - protein, 26 aa, Plasmodium falciparum
NFFTSLYLEYFSFLALDMHANIQTKI

SEQ ID NO: 3406556 - protein, 23 aa, Plasmodium falciparum
NFIFSFFLLIIKCDESVSNGRKE

SEQ ID NO: 3406557 - protein, 18 aa, Plasmodium falciparum
NFLDIYKQPVCSAYLHLC

SEQ ID NO: 3406558 - protein, 20 aa, Plasmodium falciparum
NFNALPNPKLAAKWYQMLHT

SEQ ID NO: 3406559 - protein, 21 aa, Plasmodium falciparum
NFNSLCPMGWNIVDIKNHICQ

SEQ ID NO: 3406560 - protein, 22 aa, Plasmodium falciparum
NGHNLFNKFLFFHSEINSSTIE

SEQ ID NO: 3406561 - protein, 25 aa, Plasmodium falciparum
NGIIPFVFDDLFALNIFDIHTNKPH

SEQ ID NO: 3406562 - protein, 23 aa, Plasmodium falciparum
NGKPFDINPDSMMKMFNALSNEN

SEQ ID NO: 3406563 - protein, 28 aa, Plasmodium falciparum
NGLIDETLTKMLILLSTDSHELLSHELE

SEQ ID NO: 3406564 - protein, 23 aa, Plasmodium falciparum
NGLQFNDYLLKPSITKFMFLSYN

SEQ ID NO: 3406565 - protein, 34 aa, Plasmodium falciparum
NGMAALKCILSLKDWLFKKFYDENLIKIIVMATD

SEQ ID NO: 3406566 - protein, 18 aa, Plasmodium falciparum
NGVTLTHVLIVCSIFIKL

SEQ ID NO: 3406567 - protein, 23 aa, Plasmodium falciparum
NGYLYILGQIFLQKYYAIFEKDN

SEQ ID NO: 3406568 - protein, 17 aa, Plasmodium falciparum
NHDNAYQLVPWSQVLFS

SEQ ID NO: 3406569 - protein, 20 aa, Plasmodium falciparum
NHKYIIEYILYSIFQKDMDN

SEQ ID NO: 3406570 - protein, 22 aa, Plasmodium falciparum
NHNMFPIGILAHPLDISLLDKT

SEQ ID NO: 3406571 - protein, 27 aa, Plasmodium falciparum
NICILFFVVCTLNFSTKCFSNGLLKNQ

SEQ ID NO: 3406572 - protein, 24 aa, Plasmodium falciparum
NICNNFNTIFKYDYLCVFNNQNIT

SEQ ID NO: 3406573 - protein, 23 aa, Plasmodium falciparum
NIDKLHFPFFNQMDIYFKITNEL

SEQ ID NO: 3406574 - protein, 30 aa, Plasmodium falciparum
NIDNKDTCFLDYNYMLFLKNNNCALQSKSS

SEQ ID NO: 3406575 - protein, 17 aa, Plasmodium falciparum
NIELAGIYLKKAADKGD

SEQ ID NO: 3406576 - protein, 18 aa, Plasmodium falciparum
NIEYAINYLFIYTPFIVY

SEQ ID NO: 3406577 - protein, 19 aa, Plasmodium falciparum
NIFLYTKLFVNNEEKKFII

SEQ ID NO: 3406578 - protein, 25 aa, Plasmodium falciparum
NIFNNIRMFINFYLNIKKVKSKDIL

SEQ ID NO: 3406579 - protein, 19 aa, Plasmodium falciparum
NIHPFINYHFIKASNYYIK

SEQ ID NO: 3406580 - protein, 17 aa, Plasmodium falciparum
NIKLICQQIYHNQPNQL

SEQ ID NO: 3406581 - protein, 23 aa, Plasmodium falciparum
NIKNLIIQELIYIKNKYGIHNLN

SEQ ID NO: 3406582 - protein, 19 aa, Plasmodium falciparum
NILGYIKKLAYTHLNIDYK

SEQ ID NO: 3406583 - protein, 20 aa, Plasmodium falciparum
NILICRRDWNNNIGKEVVVF

SEQ ID NO: 3406584 - protein, 18 aa, Plasmodium falciparum
NILLNKLYLTFQNITIEY

SEQ ID NO: 3406585 - protein, 20 aa, Plasmodium falciparum
NILSLLLSAGSKPLEIWKTK

SEQ ID NO: 3406586 - protein, 21 aa, Plasmodium falciparum
NINSNLAFDIILDKLKILAEF

SEQ ID NO: 3406587 - protein, 24 aa, Plasmodium falciparum
NIPATILLLRHHKIINGYINVDIK

SEQ ID NO: 3406588 - protein, 17 aa, Plasmodium falciparum
NIPFFDNLLKQNPNVDP

SEQ ID NO: 3406589 - protein, 17 aa, Plasmodium falciparum
NIQNIFPPTIYLNKNMQ

SEQ ID NO: 3406590 - protein, 25 aa, Plasmodium falciparum
NISYFDKLIFSIRDISNNINLKSII

SEQ ID NO: 3406591 - protein, 21 aa, Plasmodium falciparum
NIYIDLRMKWLSNQYNENIIS

SEQ ID NO: 3406592 - protein, 21 aa, Plasmodium falciparum
NKCASGFVNYILQNIQKRDGK

SEQ ID NO: 3406593 - protein, 18 aa, Plasmodium falciparum
NKDHGVPIYCLYSTINKK

SEQ ID NO: 3406594 - protein, 18 aa, Plasmodium falciparum
NKELPFNNKFKKIIKNIY

SEQ ID NO: 3406595 - protein, 30 aa, Plasmodium falciparum
NKEMYDILNAYFFYPSYNAYRTYVNEYFLR

SEQ ID NO: 3406596 - protein, 27 aa, Plasmodium falciparum
NKESLIFPYTYYNPYYMFRLTNNFKEN

SEQ ID NO: 3406597 - protein, 32 aa, Plasmodium falciparum
NKFDQFLLNVNKYELLKKLILNFFKDNLKDHR

SEQ ID NO: 3406598 - protein, 25 aa, Plasmodium falciparum
NKFGDLYIKFLIQFPKQLTDEQKKV

SEQ ID NO: 3406599 - protein, 22 aa, Plasmodium falciparum
NKFIKKQYIILILNKINEEIIR

SEQ ID NO: 3406600 - protein, 24 aa, Plasmodium falciparum
NKFILFFFFLFTIKTVHIETRKVC

SEQ ID NO: 3406601 - protein, 22 aa, Plasmodium falciparum
NKKNFEFILSRIYTRYVLNNLL

SEQ ID NO: 3406602 - protein, 25 aa, Plasmodium falciparum
NKKNKIILFVDEIHLLLGAGKAEGG

SEQ ID NO: 3406603 - protein, 25 aa, Plasmodium falciparum
NKKNLHKIVALRFKKLEKRLEEKNI

SEQ ID NO: 3406604 - protein, 17 aa, Plasmodium falciparum
NKKQKHFIKLNKKMKTL

SEQ ID NO: 3406605 - protein, 23 aa, Plasmodium falciparum
NKKYLNNLLKKILSNALNIPQKQ

SEQ ID NO: 3406606 - protein, 36 aa, Plasmodium falciparum
NKLFLYIKNVFLKKYFVFFLLYLINFNCDTLASQMN

SEQ ID NO: 3406607 - protein, 25 aa, Plasmodium falciparum
NKMNSKYMILLQGYLFLSDINALND

SEQ ID NO: 3406608 - protein, 24 aa, Plasmodium falciparum
NKNDLIKWYVSGLSYLPSVSTVIP

SEQ ID NO: 3406609 - protein, 28 aa, Plasmodium falciparum
NKNKKKSSFITYISTKKFKKVSQTIVSV

SEQ ID NO: 3406610 - protein, 34 aa, Plasmodium falciparum
NKSDIVHIFRDFNFLFFLTNIFSIKHDLPYFCNA

SEQ ID NO: 3406611 - protein, 28 aa, Plasmodium falciparum
NKSTIPHTIPIKSSFLKYYKGVKITGSC

SEQ ID NO: 3406612 - protein, 21 aa, Plasmodium falciparum
NKTGLLLPQLSYDLTYKNNNF

SEQ ID NO: 3406613 - protein, 17 aa, Plasmodium falciparum
NKWCTMPMVLNEGWNII

SEQ ID NO: 3406614 - protein, 25 aa, Plasmodium falciparum
NLENLNYSSIFRLLVDTYKNIKENE

SEQ ID NO: 3406615 - protein, 23 aa, Plasmodium falciparum
NLFLIILVYIFSEKKDLRCNVIK

SEQ ID NO: 3406616 - protein, 21 aa, Plasmodium falciparum
NLGFFTPPYEQIIYSDLIHNI

SEQ ID NO: 3406617 - protein, 26 aa, Plasmodium falciparum
NLGGFDHLQLWYYPDGMNNSMDGYCS

SEQ ID NO: 3406618 - protein, 24 aa, Plasmodium falciparum
NLGTGFMTYPIFSLIGLHLSDGES

SEQ ID NO: 3406619 - protein, 27 aa, Plasmodium falciparum
NLHFDTNFMIYIIRLTKYKDMNFLCSL

SEQ ID NO: 3406620 - protein, 30 aa, Plasmodium falciparum
NLHYYHFGCASWYWEYPYHYAPLCSDLLSF

SEQ ID NO: 3406621 - protein, 20 aa, Plasmodium falciparum
NLINYEFILDNLKTSVLNKL

SEQ ID NO: 3406622 - protein, 33 aa, Plasmodium falciparum
NLISLEVYDKILSTMFKILTEMSFYEDSKFYET

SEQ ID NO: 3406623 - protein, 17 aa, Plasmodium falciparum
NLIYPWNHKAHENHIIP

SEQ ID NO: 3406624 - protein, 21 aa, Plasmodium falciparum
NLKALELTRKWPRELKSIIKN

SEQ ID NO: 3406625 - protein, 29 aa, Plasmodium falciparum
NLKKKIEFNLYKLPNILLNKVPKGKTTED

SEQ ID NO: 3406626 - protein, 18 aa, Plasmodium falciparum
NLLALKELGIIYLYGYGV

SEQ ID NO: 3406627 - protein, 25 aa, Plasmodium falciparum
NLLNKKILDILLKSSFKPGASFNIP

SEQ ID NO: 3406628 - protein, 23 aa, Plasmodium falciparum
NLSNLPILQKKLINLCRIKYNKP

SEQ ID NO: 3406629 - protein, 36 aa, Plasmodium falciparum
NLSTIYGFIQSLNKIYNLFLPTYIAIIFDSKTSNND

SEQ ID NO: 3406630 - protein, 18 aa, Plasmodium falciparum
NLVKRKFFYTNSFEIYGG

SEQ ID NO: 3406631 - protein, 19 aa, Plasmodium falciparum
NLYIHKYIKFINKNNFIKA

SEQ ID NO: 3406632 - protein, 24 aa, Plasmodium falciparum
NMKHEFYCIVGVRENFFDLAQNLR

SEQ ID NO: 3406633 - protein, 25 aa, Plasmodium falciparum
NMSLDQCLYFYNSFFEHYKGIYKWH

SEQ ID NO: 3406634 - protein, 24 aa, Plasmodium falciparum
NNDEVLILITYGGYIKKIKINEKL

SEQ ID NO: 3406635 - protein, 18 aa, Plasmodium falciparum
NNEIFINNIFLKPKQYTK

SEQ ID NO: 3406636 - protein, 17 aa, Plasmodium falciparum
NNFIGGFGFIGEQIPIA

SEQ ID NO: 3406637 - protein, 24 aa, Plasmodium falciparum
NNFINFINFLPYKLKKESLYNFSK

SEQ ID NO: 3406638 - protein, 24 aa, Plasmodium falciparum
NNFKLYFNLPNIYSLAYQLFNELA

SEQ ID NO: 3406639 - protein, 24 aa, Plasmodium falciparum
NNKKNIFTFPLKHKTFYDDNLCSL

SEQ ID NO: 3406640 - protein, 26 aa, Plasmodium falciparum
NNLLNYKYDWTKFYILLFHVDNKMVA

SEQ ID NO: 3406641 - protein, 19 aa, Plasmodium falciparum
NNMMMMNIPVDIDKNSKVF

SEQ ID NO: 3406642 - protein, 24 aa, Plasmodium falciparum
NNNDNFYICNFVKDKKGRRKYNNN

SEQ ID NO: 3406643 - protein, 22 aa, Plasmodium falciparum
NNNLFIYNWVLQTSSPLALENI

SEQ ID NO: 3406644 - protein, 24 aa, Plasmodium falciparum
NNPKRPIASLMFLGPTGVGKTELS

SEQ ID NO: 3406645 - protein, 26 aa, Plasmodium falciparum
NNVNIMQMVFPDRLYMVGIAANNGLL

SEQ ID NO: 3406646 - protein, 26 aa, Plasmodium falciparum
NPAALHFLSFIYFYDFHKIEENKKRN

SEQ ID NO: 3406647 - protein, 27 aa, Plasmodium falciparum
NPGKFCQKRILLKNFSFIFIDDKRRER

SEQ ID NO: 3406648 - protein, 20 aa, Plasmodium falciparum
NPLSDMMNIFGVPQTGKEGA

SEQ ID NO: 3406649 - protein, 24 aa, Plasmodium falciparum
NPNHPIMIDLLKRSVTNPKDLELT

SEQ ID NO: 3406650 - protein, 22 aa, Plasmodium falciparum
NQDYSLYTINILNGLPDKKSNM

SEQ ID NO: 3406651 - protein, 32 aa, Plasmodium falciparum
NQIISEFRFVLFKNFHLFLQENKINYILLKCM

SEQ ID NO: 3406652 - protein, 28 aa, Plasmodium falciparum
NQSLKDIKIKMLRKLGVSYSRLPPIIKH

SEQ ID NO: 3406653 - protein, 21 aa, Plasmodium falciparum
NREIQAILPLKGKILNVEKIK

SEQ ID NO: 3406654 - protein, 23 aa, Plasmodium falciparum
NRFYLHLEEFFYILKHYVELRKI

SEQ ID NO: 3406655 - protein, 20 aa, Plasmodium falciparum
NRKKLTNLLLIVNYDGTNYN

SEQ ID NO: 3406656 - protein, 25 aa, Plasmodium falciparum
NSIIYIHPNYFFTYGYATFLNYMSI

SEQ ID NO: 3406657 - protein, 17 aa, Plasmodium falciparum
NSIKRKDIFIKLNKINN

SEQ ID NO: 3406658 - protein, 22 aa, Plasmodium falciparum
NSNINFIFPEKILHKVKEEYFV

SEQ ID NO: 3406659 - protein, 26 aa, Plasmodium falciparum
NSRSFDKFKWIQDNLFGGGFYITTGT

SEQ ID NO: 3406660 - protein, 32 aa, Plasmodium falciparum
NSSAAFTALPPPPPPVPPPPPPTLTPSGIVGN

SEQ ID NO: 3406661 - protein, 25 aa, Plasmodium falciparum
NSVRIAWKALTNYALYECKNIFIKN

SEQ ID NO: 3406662 - protein, 17 aa, Plasmodium falciparum
NSYLWYISDPIIDINYL

SEQ ID NO: 3406663 - protein, 22 aa, Plasmodium falciparum
NTDPYNHYFAWEIGGGAPTYKP

SEQ ID NO: 3406664 - protein, 37 aa, Plasmodium falciparum
NTKNETYLLKYYLSALISFVPFIKPAMKIYYDQRYIN

SEQ ID NO: 3406665 - protein, 17 aa, Plasmodium falciparum
NTKNYFINTFSITWYNT

SEQ ID NO: 3406666 - protein, 26 aa, Plasmodium falciparum
NTNGSQFFILFIPTPWLDGRHVVFGE

SEQ ID NO: 3406667 - protein, 22 aa, Plasmodium falciparum
NTNYYYILQTFNHMIKALHNKS

SEQ ID NO: 3406668 - protein, 26 aa, Plasmodium falciparum
NTTNLFLNMYLLKLASEYNFYTDFLK

SEQ ID NO: 3406669 - protein, 27 aa, Plasmodium falciparum
NTTSYILMFIPLYKYYSNYIIQMKITS

SEQ ID NO: 3406670 - protein, 23 aa, Plasmodium falciparum
NTYKLETFLFSWKYNFTKNKNII

SEQ ID NO: 3406671 - protein, 25 aa, Plasmodium falciparum
NTYNRSFLNFLKYTTKNNLKEKKNI

SEQ ID NO: 3406672 - protein, 30 aa, Plasmodium falciparum
NVEYQTFFVHPFNLLLLLSIDNEHPNNQRI

SEQ ID NO: 3406673 - protein, 31 aa, Plasmodium falciparum
NVIGFLGIMKIFFKKLFFDFNIFSKNNKKNI

SEQ ID NO: 3406674 - protein, 24 aa, Plasmodium falciparum
NVIYKLLLYDIFDVTFKPISILVN

SEQ ID NO: 3406675 - protein, 25 aa, Plasmodium falciparum
NVKNIFKEFLYYYINKKDPNYQLKL

SEQ ID NO: 3406676 - protein, 26 aa, Plasmodium falciparum
NVLESTLLYFRKYKLFFKNMYNFKQK

SEQ ID NO: 3406677 - protein, 20 aa, Plasmodium falciparum
NVLLCVLMKNYLCLLKNKRN

SEQ ID NO: 3406678 - protein, 17 aa, Plasmodium falciparum
NVLLIKKKILCCSNFVD

SEQ ID NO: 3406679 - protein, 29 aa, Plasmodium falciparum
NVLYIKKEWFTLYLYTLLELLGIEVNMEH

SEQ ID NO: 3406680 - protein, 23 aa, Plasmodium falciparum
NVPYHLKNCRIFQLNLGNIVAGT

SEQ ID NO: 3406681 - protein, 28 aa, Plasmodium falciparum
NVSFSNIYMHPFDFKPYTPTPTLDTESF

SEQ ID NO: 3406682 - protein, 24 aa, Plasmodium falciparum
NVSLFFLLIFKYSYKNIVKKVLQD

SEQ ID NO: 3406683 - protein, 20 aa, Plasmodium falciparum
NVVFKPWDFVIPAAADVNQK

SEQ ID NO: 3406684 - protein, 20 aa, Plasmodium falciparum
NYDHLVYLVLDLNKITDLSR

SEQ ID NO: 3406685 - protein, 19 aa, Plasmodium falciparum
NYHFINTVLVFNIDIPMMN

SEQ ID NO: 3406686 - protein, 20 aa, Plasmodium falciparum
NYINIFDWLNVYSETFVLGG

SEQ ID NO: 3406687 - protein, 20 aa, Plasmodium falciparum
NYIRSYYYIYKNNLGRDKKI

SEQ ID NO: 3406688 - protein, 23 aa, Plasmodium falciparum
NYIYTCSDIILPYLLSFNMHENN

SEQ ID NO: 3406689 - protein, 19 aa, Plasmodium falciparum
NYLFIYTPFIVYPSDDILK

SEQ ID NO: 3406690 - protein, 24 aa, Plasmodium falciparum
NYNKQLKYKINFCRNLYFNNKNEY

SEQ ID NO: 3406691 - protein, 28 aa, Plasmodium falciparum
PCEKYNYFPLIPFINTSFNWLYDQNINL

SEQ ID NO: 3406692 - protein, 19 aa, Plasmodium falciparum
PCIRDMFFIYKRELYNICL

SEQ ID NO: 3406693 - protein, 23 aa, Plasmodium falciparum
PECLKLYKLFRERSIREPLKYLH

SEQ ID NO: 3406694 - protein, 20 aa, Plasmodium falciparum
PFLTTCDYLLSNILGAVVDS

SEQ ID NO: 3406695 - protein, 17 aa, Plasmodium falciparum
PFVLMIDVKRENSFFLR

SEQ ID NO: 3406696 - protein, 19 aa, Plasmodium falciparum
PGEYNICLAQFYQDPEKDD

SEQ ID NO: 3406697 - protein, 24 aa, Plasmodium falciparum
PGIGPKFYKLLFNPDNYYIDENNS

SEQ ID NO: 3406698 - protein, 20 aa, Plasmodium falciparum
PGISKNYFKGFKLYNSREMK

SEQ ID NO: 3406699 - protein, 21 aa, Plasmodium falciparum
PGSCFWLPHGSKIYNKLIEFI

SEQ ID NO: 3406700 - protein, 22 aa, Plasmodium falciparum
PHISHIILYWKSNNIMEEIIPS

SEQ ID NO: 3406701 - protein, 28 aa, Plasmodium falciparum
PHKPGKYFIVYSYYRPFDPTRDTNTRIV

SEQ ID NO: 3406702 - protein, 19 aa, Plasmodium falciparum
PIDLRIDDYIKFSPFSNES

SEQ ID NO: 3406703 - protein, 24 aa, Plasmodium falciparum
PIHNQLELFHKWLDRHRDMCEKLK

SEQ ID NO: 3406704 - protein, 17 aa, Plasmodium falciparum
PIIITYPQPLSEDEIIY

SEQ ID NO: 3406705 - protein, 27 aa, Plasmodium falciparum
PIYELYYVFIKTFIEYILLPEKLTQEE

SEQ ID NO: 3406706 - protein, 19 aa, Plasmodium falciparum
PIYFEYIKEGNYKGMCKPD

SEQ ID NO: 3406707 - protein, 20 aa, Plasmodium falciparum
PKVIYNWKLGKDSLLKMLCM

SEQ ID NO: 3406708 - protein, 34 aa, Plasmodium falciparum
PLERNYAWQLYDDPRFFFLSKKTNKHKKEGTPNS

SEQ ID NO: 3406709 - protein, 21 aa, Plasmodium falciparum
PLNITPLYDRVLIKLINPNVN

SEQ ID NO: 3406710 - protein, 19 aa, Plasmodium falciparum
PLWNAKPFSLMKLPFNPQD

SEQ ID NO: 3406711 - protein, 24 aa, Plasmodium falciparum
PMLVKNIILLSYIKVKKGKYHITI

SEQ ID NO: 3406712 - protein, 25 aa, Plasmodium falciparum
PNCSKHFYLLIKKGSQKKMISKVLH

SEQ ID NO: 3406713 - protein, 41 aa, Plasmodium falciparum
PNGSKSLPIYLLPYLERFKKIHLWLDFDKAGKSSVFNFVNK

SEQ ID NO: 3406714 - protein, 17 aa, Plasmodium falciparum
PNYILKHNYIYSNNIFN

SEQ ID NO: 3406715 - protein, 18 aa, Plasmodium falciparum
PNYNTLWKIKKCGYFFLS

SEQ ID NO: 3406716 - protein, 19 aa, Plasmodium falciparum
PPYMRNVVFHFFKSNQFID

SEQ ID NO: 3406717 - protein, 21 aa, Plasmodium falciparum
PPYNNIYNIIFFIYNYNDQDN

SEQ ID NO: 3406718 - protein, 26 aa, Plasmodium falciparum
PQNLKWNYFYYLLKNGLNTDYNNENF

SEQ ID NO: 3406719 - protein, 24 aa, Plasmodium falciparum
PRRTKLCLRNINKVWHRIKDEKNF

SEQ ID NO: 3406720 - protein, 23 aa, Plasmodium falciparum
PSNKFFSILLKCSVDNLGSGDST

SEQ ID NO: 3406721 - protein, 17 aa, Plasmodium falciparum
PSVIEIFYLSGKIVAFE

SEQ ID NO: 3406722 - protein, 19 aa, Plasmodium falciparum
PTFKIKRFNVFKDFSFYID

SEQ ID NO: 3406723 - protein, 25 aa, Plasmodium falciparum
PTLKIRRFNVFKDFSFFIDEVKKKY

SEQ ID NO: 3406724 - protein, 24 aa, Plasmodium falciparum
PTLKIRRFNVFKDFSFYIDQVKKK

SEQ ID NO: 3406725 - protein, 24 aa, Plasmodium falciparum
PTLKVKRFRVFKDYSFFIDEVKKI

SEQ ID NO: 3406726 - protein, 22 aa, Plasmodium falciparum
PVNIHCYALLKPLDTLYVKCPT

SEQ ID NO: 3406727 - protein, 18 aa, Plasmodium falciparum
PWKFELIPKFTKLSHGDI

SEQ ID NO: 3406728 - protein, 25 aa, Plasmodium falciparum
PYKGGLRFHPTVNLSVIKFLGFEQI

SEQ ID NO: 3406729 - protein, 29 aa, Plasmodium falciparum
QAQQKSYYIYYYYKIKLLQLLNQTANEII

SEQ ID NO: 3406730 - protein, 17 aa, Plasmodium falciparum
QCIIPSTPKYKYSYINS

SEQ ID NO: 3406731 - protein, 36 aa, Plasmodium falciparum
QDEKFFINLYEYLYNYLHKEFGLPQPIYELYYVFIK

SEQ ID NO: 3406732 - protein, 24 aa, Plasmodium falciparum
QEKDVDIIYLLNKVQKLNDINLKN

SEQ ID NO: 3406733 - protein, 19 aa, Plasmodium falciparum
QFFSYKGKFIPINAFITLE

SEQ ID NO: 3406734 - protein, 21 aa, Plasmodium falciparum
QFVFQFLIITSTALGKAFIQA

SEQ ID NO: 3406735 - protein, 31 aa, Plasmodium falciparum
QGDNNIYNYYNKYVLPYFLNNNENDIYDEDN

SEQ ID NO: 3406736 - protein, 18 aa, Plasmodium falciparum
QIFHVLKHIKNSRIKMGL

SEQ ID NO: 3406737 - protein, 17 aa, Plasmodium falciparum
QIGLLLEIKHYINFIFD

SEQ ID NO: 3406738 - protein, 18 aa, Plasmodium falciparum
QIKYFDEYFFASGGKIKV

SEQ ID NO: 3406739 - protein, 23 aa, Plasmodium falciparum
QIQLERMFKLNVLLNKGGVKKER

SEQ ID NO: 3406740 - protein, 17 aa, Plasmodium falciparum
QIQPVKYHEGRAYTYFF

SEQ ID NO: 3406741 - protein, 21 aa, Plasmodium falciparum
QITEIILSYNKGDLIFLDDKR

SEQ ID NO: 3406742 - protein, 26 aa, Plasmodium falciparum
QKHGKIYLMKITKGIPFQLLTKTHIS

SEQ ID NO: 3406743 - protein, 26 aa, Plasmodium falciparum
QKHLSKIIFISTPFKGSVKTIRALIQ

SEQ ID NO: 3406744 - protein, 24 aa, Plasmodium falciparum
QKKSYWIVRNSWGKHWGDKGHFKV

SEQ ID NO: 3406745 - protein, 25 aa, Plasmodium falciparum
QKLCSCLFNFYYYDEIYECQPFGFF

SEQ ID NO: 3406746 - protein, 26 aa, Plasmodium falciparum
QKRNISFIYVLNMLSTFYKIKFNSSK

SEQ ID NO: 3406747 - protein, 19 aa, Plasmodium falciparum
QLIIFQDKFNYIKMNGKLP

SEQ ID NO: 3406748 - protein, 32 aa, Plasmodium falciparum
QLLFKFISMFYHVPLLENLLNLYKNKLTYDIE

SEQ ID NO: 3406749 - protein, 29 aa, Plasmodium falciparum
QLNIIDLYLIIQNKILDIITFFQKNQNIE

SEQ ID NO: 3406750 - protein, 23 aa, Plasmodium falciparum
QMSIRRQILKQLLLLEKKYIEKG

SEQ ID NO: 3406751 - protein, 22 aa, Plasmodium falciparum
QNECDLIKKLIITFSQENVEMK

SEQ ID NO: 3406752 - protein, 22 aa, Plasmodium falciparum
QNNGIFKLLGIYGSNSINWLAS

SEQ ID NO: 3406753 - protein, 21 aa, Plasmodium falciparum
QNNIPFKDTIWSYTLTNEGLI

SEQ ID NO: 3406754 - protein, 21 aa, Plasmodium falciparum
QNPYKFNVHEKYNLGFFTPPY

SEQ ID NO: 3406755 - protein, 18 aa, Plasmodium falciparum
QNRKKIFRLFSNDNEKIT

SEQ ID NO: 3406756 - protein, 26 aa, Plasmodium falciparum
QNSFKLNIIKFYELLMNIQKIMKDNL

SEQ ID NO: 3406757 - protein, 28 aa, Plasmodium falciparum
QRSINAKYLIFFFKNLHVWKTDLFCQNI

SEQ ID NO: 3406758 - protein, 25 aa, Plasmodium falciparum
QRVMDYFIKMFKKKNNIDLRTDKRA

SEQ ID NO: 3406759 - protein, 18 aa, Plasmodium falciparum
QTCKCSERFVLENGVCIC

SEQ ID NO: 3406760 - protein, 26 aa, Plasmodium falciparum
QTDTFLQKLIMEYYDERKRRTFFDDT

SEQ ID NO: 3406761 - protein, 25 aa, Plasmodium falciparum
RAELKRIKDIPPIISYYIYNKNKNE

SEQ ID NO: 3406762 - protein, 20 aa, Plasmodium falciparum
RAIIESLLRYNKNSPVLVGN

SEQ ID NO: 3406763 - protein, 20 aa, Plasmodium falciparum
RAIQILSRRTKNNPILLGDP

SEQ ID NO: 3406764 - protein, 24 aa, Plasmodium falciparum
RCMKGYDHLGISALYLTNCSKGKI

SEQ ID NO: 3406765 - protein, 98 aa, Plasmodium falciparum
RDGKETFDDLLNYILKLKEIYNMSTMDFIGAFLILESFNLNIINEYPLREWILVTFHYIKGMITLQNIKFIIKSLDLNHLIISNITAAFYMNIKPIKV

SEQ ID NO: 3406766 - protein, 19 aa, Plasmodium falciparum
RDILNLKIRLTLPKQFSWG

SEQ ID NO: 3406767 - protein, 29 aa, Plasmodium falciparum
RDPFILHKLMPKFFYTRLLHIYKYLKRNE

SEQ ID NO: 3406768 - protein, 27 aa, Plasmodium falciparum
RDSIKEIFLKALDDKKYREVFKNFMYG

SEQ ID NO: 3406769 - protein, 18 aa, Plasmodium falciparum
REEYLPKISTLRKGKYSY

SEQ ID NO: 3406770 - protein, 26 aa, Plasmodium falciparum
REKYMDDFFLVKYINNIWINKNVHKY

SEQ ID NO: 3406771 - protein, 17 aa, Plasmodium falciparum
RFLFYPSCHDESAIFYL

SEQ ID NO: 3406772 - protein, 19 aa, Plasmodium falciparum
RFVVDGASIFLRNPYKITL

SEQ ID NO: 3406773 - protein, 26 aa, Plasmodium falciparum
RGNVTSNIKFPSDNKGKIIRGSNDKL

SEQ ID NO: 3406774 - protein, 17 aa, Plasmodium falciparum
RHAIFYKSEKRITTLLS

SEQ ID NO: 3406775 - protein, 24 aa, Plasmodium falciparum
RIAMIKWDIDRIRDLYLYIYNTEK

SEQ ID NO: 3406776 - protein, 18 aa, Plasmodium falciparum
RIIEILGRKKKSNPLLIG

SEQ ID NO: 3406777 - protein, 22 aa, Plasmodium falciparum
RIKKHRWFPKLLRSNDPLIFSV

SEQ ID NO: 3406778 - protein, 17 aa, Plasmodium falciparum
RIKYYRITKKLILEWHE

SEQ ID NO: 3406779 - protein, 21 aa, Plasmodium falciparum
RKDLHTYFIDKRKYFHLNKKD

SEQ ID NO: 3406780 - protein, 18 aa, Plasmodium falciparum
RKIFSHKKIYFNFKVSKN

SEQ ID NO: 3406781 - protein, 27 aa, Plasmodium falciparum
RKKKNLNRLFYTLKLTNNFSFKNSKNR

SEQ ID NO: 3406782 - protein, 17 aa, Plasmodium falciparum
RKKTEIFFINSAKSYII

SEQ ID NO: 3406783 - protein, 18 aa, Plasmodium falciparum
RKLAKPDDNFYELSPYAS

SEQ ID NO: 3406784 - protein, 28 aa, Plasmodium falciparum
RKLNKKILILYVPVFEMSKFISTIDILK

SEQ ID NO: 3406785 - protein, 23 aa, Plasmodium falciparum
RKNFPALVSLYKPLWSNRKYGEE

SEQ ID NO: 3406786 - protein, 25 aa, Plasmodium falciparum
RKNLYRQPLYILKYKIYNKKKKFKL

SEQ ID NO: 3406787 - protein, 17 aa, Plasmodium falciparum
RKRIYKSIPIFHIGNVV

SEQ ID NO: 3406788 - protein, 27 aa, Plasmodium falciparum
RKVLRWSRMWWVLLVREIVGDNTIEKK

SEQ ID NO: 3406789 - protein, 18 aa, Plasmodium falciparum
RMTAHSRFLFVHDKYKRN

SEQ ID NO: 3406790 - protein, 19 aa, Plasmodium falciparum
RNEKVFAVLFFKKSNKNIK

SEQ ID NO: 3406791 - protein, 18 aa, Plasmodium falciparum
RNFLKLHSYIYTCNKYNE

SEQ ID NO: 3406792 - protein, 23 aa, Plasmodium falciparum
RNKIAKLLLFKTMQYPKSISLDT

SEQ ID NO: 3406793 - protein, 19 aa, Plasmodium falciparum
RNLKKFLHPFQYSLYENTV

SEQ ID NO: 3406794 - protein, 17 aa, Plasmodium falciparum
RNVGKILNLFFFEKETS

SEQ ID NO: 3406795 - protein, 22 aa, Plasmodium falciparum
RNYLMNVRKLSIDTLKKFLIGF

SEQ ID NO: 3406796 - protein, 30 aa, Plasmodium falciparum
RPHLSLCVFLLVCIFYPTAYHKSSSGSCVN

SEQ ID NO: 3406797 - protein, 19 aa, Plasmodium falciparum
RQSFFFFSYKSHVSIPHFF

SEQ ID NO: 3406798 - protein, 21 aa, Plasmodium falciparum
RRALLRALTTSLLRYGKIVTT

SEQ ID NO: 3406799 - protein, 20 aa, Plasmodium falciparum
RRIFPYLLRHSFATIAATSN

SEQ ID NO: 3406800 - protein, 32 aa, Plasmodium falciparum
RRKKLSYFHSLLLIIFSFFLSCARGMDYYKRL

SEQ ID NO: 3406801 - protein, 17 aa, Plasmodium falciparum
RRLVRKILSLRKSDHNG

SEQ ID NO: 3406802 - protein, 17 aa, Plasmodium falciparum
RSSLLDAIYGYQKKWKE

SEQ ID NO: 3406803 - protein, 21 aa, Plasmodium falciparum
RTEIIYRDFLKHFFKHKTPHV

SEQ ID NO: 3406804 - protein, 27 aa, Plasmodium falciparum
RVEKILIRALLSLDFSLFITYFQQKHG

SEQ ID NO: 3406805 - protein, 28 aa, Plasmodium falciparum
RVLNLLSEVVIRRSSRFKLLKTDTEKQN

SEQ ID NO: 3406806 - protein, 20 aa, Plasmodium falciparum
RYIEVLKKEGWRDQIYLYWS

SEQ ID NO: 3406807 - protein, 18 aa, Plasmodium falciparum
RYIPYRSGTYKGRTYIYM

SEQ ID NO: 3406808 - protein, 32 aa, Plasmodium falciparum
RYNNNNKILLFCLVILILYKYTYSLHNRWNKN

SEQ ID NO: 3406809 - protein, 21 aa, Plasmodium falciparum
RYSGYWKIIYDEGLYIEVYKE

SEQ ID NO: 3406810 - protein, 26 aa, Plasmodium falciparum
SCSYDNYICGALNYMNNIYSKGDRVI

SEQ ID NO: 3406811 - protein, 23 aa, Plasmodium falciparum
SDGKYFFEVLFLCGNNNLRVNSF

SEQ ID NO: 3406812 - protein, 20 aa, Plasmodium falciparum
SDHIFLKSPILLQYDPEKIV

SEQ ID NO: 3406813 - protein, 25 aa, Plasmodium falciparum
SDKKKKYIYFILKKMEFPVETIFNE

SEQ ID NO: 3406814 - protein, 29 aa, Plasmodium falciparum
SDKVKYNLLNDLLISILYINVYDIEETVR

SEQ ID NO: 3406815 - protein, 23 aa, Plasmodium falciparum
SDPLKILYINIYQQPYILDSFGL

SEQ ID NO: 3406816 - protein, 19 aa, Plasmodium falciparum
SDRYIPYSPLSPKVLDNER

SEQ ID NO: 3406817 - protein, 26 aa, Plasmodium falciparum
SEDSKFTRPWLLKYNVNYEKVKKAVE

SEQ ID NO: 3406818 - protein, 27 aa, Plasmodium falciparum
SEETNNEIMVPLPSPLTDVTTPEEHKE

SEQ ID NO: 3406819 - protein, 20 aa, Plasmodium falciparum
SEHFFSMLFSNDAVTLFIIY

SEQ ID NO: 3406820 - protein, 24 aa, Plasmodium falciparum
SFAWDLLTNVYKINPDRLYVTYFG

SEQ ID NO: 3406821 - protein, 19 aa, Plasmodium falciparum
SFDILSFRNFDKFLYSNKC

SEQ ID NO: 3406822 - protein, 27 aa, Plasmodium falciparum
SFEKLYNVYYPFIFQIYEHLNTTITKL

SEQ ID NO: 3406823 - protein, 19 aa, Plasmodium falciparum
SFFAFYYHGRIRKMYVSFK

SEQ ID NO: 3406824 - protein, 18 aa, Plasmodium falciparum
SFFLCVVYAQIPYDVQRI

SEQ ID NO: 3406825 - protein, 19 aa, Plasmodium falciparum
SFFLFCMVHFVFCDKNTFP

SEQ ID NO: 3406826 - protein, 20 aa, Plasmodium falciparum
SFIFSNRKKLTNLLLIVNYD

SEQ ID NO: 3406827 - protein, 23 aa, Plasmodium falciparum
SFKFLCLTVCLILTIYSSRNEIH

SEQ ID NO: 3406828 - protein, 17 aa, Plasmodium falciparum
SFLKYYKGVKITGSCGV

SEQ ID NO: 3406829 - protein, 17 aa, Plasmodium falciparum
SFLLKKKPKSPVDLLRV

SEQ ID NO: 3406830 - protein, 23 aa, Plasmodium falciparum
SFLLVLLNVLHICIKFSVADLPT

SEQ ID NO: 3406831 - protein, 20 aa, Plasmodium falciparum
SFLVVLVFNKTIGYNIKSGN

SEQ ID NO: 3406832 - protein, 17 aa, Plasmodium falciparum
SFWEKMIKLDSSKYAWT

SEQ ID NO: 3406833 - protein, 24 aa, Plasmodium falciparum
SGHFGSGWIWLIIKDRKLEIFQGH

SEQ ID NO: 3406834 - protein, 32 aa, Plasmodium falciparum
SGKNQTFKFVLYFKDDILTIKWKVYEEKSATP

SEQ ID NO: 3406835 - protein, 19 aa, Plasmodium falciparum
SHIYMIRKNVTFFGLRNNK

SEQ ID NO: 3406836 - protein, 21 aa, Plasmodium falciparum
SIACEAYWPCYTDCISEEYIS

SEQ ID NO: 3406837 - protein, 43 aa, Plasmodium falciparum
SIATYIIRELYYLSQKYYFPNLTVAALKWVYTRSFITSTIIGV

SEQ ID NO: 3406838 - protein, 21 aa, Plasmodium falciparum
SIDIIIDILNNTKLEWLCLDL

SEQ ID NO: 3406839 - protein, 24 aa, Plasmodium falciparum
SIFINLFYLLPCFSQISFVDNIYA

SEQ ID NO: 3406840 - protein, 27 aa, Plasmodium falciparum
SIHQNYFYDSFYGRDYLIMKSKGVHVE

SEQ ID NO: 3406841 - protein, 20 aa, Plasmodium falciparum
SIIHFLNNKYSKNVHIIFLY

SEQ ID NO: 3406842 - protein, 25 aa, Plasmodium falciparum
SIKNTHWDIYDKKKYFFIGNNHLKN

SEQ ID NO: 3406843 - protein, 23 aa, Plasmodium falciparum
SILFKNFFGMPFLKNDNDVNLST

SEQ ID NO: 3406844 - protein, 24 aa, Plasmodium falciparum
SILKKKFFHFFYNDLEKKKKVQLY

SEQ ID NO: 3406845 - protein, 17 aa, Plasmodium falciparum
SIMKTLAGLIKGNNQID

SEQ ID NO: 3406846 - protein, 20 aa, Plasmodium falciparum
SIVDWLLQMTGPVFSHVEGN

SEQ ID NO: 3406847 - protein, 18 aa, Plasmodium falciparum
SIVYLPSLKNMVAWAGYA

SEQ ID NO: 3406848 - protein, 18 aa, Plasmodium falciparum
SKDLYYIITGYTSKSDLL

SEQ ID NO: 3406849 - protein, 35 aa, Plasmodium falciparum
SKEDDYNYLYFYHIYKKMKLIKREKYIYNPTKYES

SEQ ID NO: 3406850 - protein, 18 aa, Plasmodium falciparum
SKFNFFKLYYYNTYNCLN

SEQ ID NO: 3406851 - protein, 25 aa, Plasmodium falciparum
SKGSRFVYASYILGLVFFIESHIDI

SEQ ID NO: 3406852 - protein, 29 aa, Plasmodium falciparum
SKHTSVFPGLYFIGIGYNLLFGNPLGEAD

SEQ ID NO: 3406853 - protein, 23 aa, Plasmodium falciparum
SKIIGFYLLNNACVIKYIGNKKN

SEQ ID NO: 3406854 - protein, 23 aa, Plasmodium falciparum
SKINFFNIYEYLITITKYKENKN

SEQ ID NO: 3406855 - protein, 26 aa, Plasmodium falciparum
SKRNVKIIFGIWPPVYNIFMKNYKNG

SEQ ID NO: 3406856 - protein, 27 aa, Plasmodium falciparum
SLEDHVNLLFNFLQTNNQLDPSLKDLE

SEQ ID NO: 3406857 - protein, 17 aa, Plasmodium falciparum
SLFILLINVVLHGAQKN

SEQ ID NO: 3406858 - protein, 24 aa, Plasmodium falciparum
SLGSLFDILPYREYYKRDQVVILI

SEQ ID NO: 3406859 - protein, 17 aa, Plasmodium falciparum
SLIGQFGVGFYSAFLVA

SEQ ID NO: 3406860 - protein, 18 aa, Plasmodium falciparum
SLKDVPILLPNNIELSCF

SEQ ID NO: 3406861 - protein, 35 aa, Plasmodium falciparum
SLKSQIDIRYYLRGLFPFRPWIDVITKSDLINFDQ

SEQ ID NO: 3406862 - protein, 24 aa, Plasmodium falciparum
SLMSIIFGNLLTKYKRKKKSSLNS

SEQ ID NO: 3406863 - protein, 19 aa, Plasmodium falciparum
SLNSLLNKDIKILAVLKSP

SEQ ID NO: 3406864 - protein, 20 aa, Plasmodium falciparum
SLRIKCSSLLGIDFGNEYIK

SEQ ID NO: 3406865 - protein, 32 aa, Plasmodium falciparum
SLRNYRRLYKLYSAFYLKLPLHINTKTNKIHT

SEQ ID NO: 3406866 - protein, 21 aa, Plasmodium falciparum
SLVTPLWMKRLCDNSNDVGFK

SEQ ID NO: 3406867 - protein, 21 aa, Plasmodium falciparum
SLYGYKHIMNFLLGNLNKHKN

SEQ ID NO: 3406868 - protein, 29 aa, Plasmodium falciparum
SLYLFFFISYAEIIFCIRIKRNNLYNFQN

SEQ ID NO: 3406869 - protein, 25 aa, Plasmodium falciparum
SLYVYKHIMKFFLDKYKSIPNEIAL

SEQ ID NO: 3406870 - protein, 20 aa, Plasmodium falciparum
SNAYVMIQSYRLLVSKQYER

SEQ ID NO: 3406871 - protein, 19 aa, Plasmodium falciparum
SNCWLPCLFGSPCSDRCYN

SEQ ID NO: 3406872 - protein, 17 aa, Plasmodium falciparum
SNDFIEHKLLLFEKPVL

SEQ ID NO: 3406873 - protein, 19 aa, Plasmodium falciparum
SNILYLYNFSDKEKITISH

SEQ ID NO: 3406874 - protein, 18 aa, Plasmodium falciparum
SNLLRHAIFYKSEKRITT

SEQ ID NO: 3406875 - protein, 18 aa, Plasmodium falciparum
SPKRRLVRKILSLRKSDH

SEQ ID NO: 3406876 - protein, 23 aa, Plasmodium falciparum
SPKRRLVRKILSLRKSDHNGPFS

SEQ ID NO: 3406877 - protein, 29 aa, Plasmodium falciparum
SPRVISALFMYFLNKVNIFLVPQYVTRNR

SEQ ID NO: 3406878 - protein, 33 aa, Plasmodium falciparum
SQFVTIKGYNLHECLQFLVVKKNSTCGPMTIEK

SEQ ID NO: 3406879 - protein, 19 aa, Plasmodium falciparum
SRIIFLNKLDKVGANFEGC

SEQ ID NO: 3406880 - protein, 25 aa, Plasmodium falciparum
SRKDFISFRITKLIKLSIPESMMKA

SEQ ID NO: 3406881 - protein, 52 aa, Plasmodium falciparum
SRYTLLSGMVVSFWLFYRSENFNLLRRLISKLRSLFPLFIKNNFLNNEIKNS

SEQ ID NO: 3406882 - protein, 24 aa, Plasmodium falciparum
SSFGFLLCGLFLLLNNNVFQKWSN

SEQ ID NO: 3406883 - protein, 25 aa, Plasmodium falciparum
SSGIFLHSFRYTWTNIFDVFTLLPK

SEQ ID NO: 3406884 - protein, 22 aa, Plasmodium falciparum
SSIFLFFLKPNVPKGAYGLKNV

SEQ ID NO: 3406885 - protein, 24 aa, Plasmodium falciparum
SSKYPYYLKIPHFVNEQYTIQCKC

SEQ ID NO: 3406886 - protein, 19 aa, Plasmodium falciparum
SSLLLTGFNALNKILGENV

SEQ ID NO: 3406887 - protein, 24 aa, Plasmodium falciparum
SSNTHHFLIYPINPMPKFVFKDEI

SEQ ID NO: 3406888 - protein, 27 aa, Plasmodium falciparum
SSVFGSIFGSLLTPIDSLLEKFIGSNN

SEQ ID NO: 3406889 - protein, 23 aa, Plasmodium falciparum
SSVNKFIYVFKKILINEDNPNST

SEQ ID NO: 3406890 - protein, 32 aa, Plasmodium falciparum
STLSNRKVIFPYFSFTKALNYPVQGTCADILK

SEQ ID NO: 3406891 - protein, 18 aa, Plasmodium falciparum
SVGLIFRSYDKYNFYMLE

SEQ ID NO: 3406892 - protein, 24 aa, Plasmodium falciparum
SVKKKPFSIILFDEIEKAHSEVLH

SEQ ID NO: 3406893 - protein, 25 aa, Plasmodium falciparum
SVQVLNGFYYPSIISGPQIINDHIK

SEQ ID NO: 3406894 - protein, 25 aa, Plasmodium falciparum
SWKKRDPILFLSSYMKKYNLVQESY

SEQ ID NO: 3406895 - protein, 18 aa, Plasmodium falciparum
SWREQHGYILGLKLDVDD

SEQ ID NO: 3406896 - protein, 27 aa, Plasmodium falciparum
TCGLCCYLYSYCYNGRFFKNGRGSNRN

SEQ ID NO: 3406897 - protein, 18 aa, Plasmodium falciparum
TDINKLNFSNLIYEQNEQ

SEQ ID NO: 3406898 - protein, 18 aa, Plasmodium falciparum
TDYFKLYNNNYSNLGFKY

SEQ ID NO: 3406899 - protein, 35 aa, Plasmodium falciparum
TEDIKKIFLNCLYDNLLDLYYLKNLQDDFIKRENE

SEQ ID NO: 3406900 - protein, 37 aa, Plasmodium falciparum
TEFLRYSIGYQRKWIYKFVLFYIIKGSEKYILNDGND

SEQ ID NO: 3406901 - protein, 27 aa, Plasmodium falciparum
TEISNLPPFKRWLVKRIISMRKANNNG

SEQ ID NO: 3406902 - protein, 22 aa, Plasmodium falciparum
TENNLICDISLIPKTVIGIKCP

SEQ ID NO: 3406903 - protein, 29 aa, Plasmodium falciparum
TETSKKLWFDLLYAYDKFGWFYIHPNEVI

SEQ ID NO: 3406904 - protein, 23 aa, Plasmodium falciparum
TFFIYLIFVIGYVTQINGRSKCF

SEQ ID NO: 3406905 - protein, 17 aa, Plasmodium falciparum
TFPFFKNINSISGIGNV

SEQ ID NO: 3406906 - protein, 25 aa, Plasmodium falciparum
TFVDINNIYFYFKKVNITNINKDNI

SEQ ID NO: 3406907 - protein, 28 aa, Plasmodium falciparum
TGPCNENFIMFLVPHIYIDVDTEDTNIE

SEQ ID NO: 3406908 - protein, 26 aa, Plasmodium falciparum
TGPCRSYFRVMLVPHITVYVYATYDR

SEQ ID NO: 3406909 - protein, 26 aa, Plasmodium falciparum
TGSCGVQFQLVIVPHLFIYVETKENN

SEQ ID NO: 3406910 - protein, 26 aa, Plasmodium falciparum
TGSCNANFQLFLVPHIFINVETKENN

SEQ ID NO: 3406911 - protein, 17 aa, Plasmodium falciparum
THLTYGTHTSFLQNCTI

SEQ ID NO: 3406912 - protein, 22 aa, Plasmodium falciparum
TIFPSFIQLYSKLTETPPVVLV

SEQ ID NO: 3406913 - protein, 21 aa, Plasmodium falciparum
TILYTMKYYNAQWAHFSFRLK

SEQ ID NO: 3406914 - protein, 18 aa, Plasmodium falciparum
TITKLYNIIIKKLKDNDV

SEQ ID NO: 3406915 - protein, 20 aa, Plasmodium falciparum
TKICNQLNNMSLRNFRTLVE

SEQ ID NO: 3406916 - protein, 25 aa, Plasmodium falciparum
TKIKQYILRIPPYVHKDIHFSLEFN

SEQ ID NO: 3406917 - protein, 17 aa, Plasmodium falciparum
TKLEWICVDLDLVEGIL

SEQ ID NO: 3406918 - protein, 24 aa, Plasmodium falciparum
TKNGYIIQFPLSSFKISKKNSLGN

SEQ ID NO: 3406919 - protein, 18 aa, Plasmodium falciparum
TKPCPQNWILKKGNHKLS

SEQ ID NO: 3406920 - protein, 20 aa, Plasmodium falciparum
TKPVILKYIALNNKKYLNKY

SEQ ID NO: 3406921 - protein, 23 aa, Plasmodium falciparum
TLEMRMIFSNFTNLLIDILNKLY

SEQ ID NO: 3406922 - protein, 26 aa, Plasmodium falciparum
TLENKINYIFFNYIPLENYVNNGDAL

SEQ ID NO: 3406923 - protein, 19 aa, Plasmodium falciparum
TLFISPYVRTNTPFYCFCN

SEQ ID NO: 3406924 - protein, 22 aa, Plasmodium falciparum
TLFYLSLFFSYTFKGLKCTRIY

SEQ ID NO: 3406925 - protein, 24 aa, Plasmodium falciparum
TLKENKFLPYIKKYHILQELEQIE

SEQ ID NO: 3406926 - protein, 28 aa, Plasmodium falciparum
TLKHFHFIGLFNERLYMLTKLLRRNYQF

SEQ ID NO: 3406927 - protein, 20 aa, Plasmodium falciparum
TLLIVYTHWSYNSNLLLENL

SEQ ID NO: 3406928 - protein, 23 aa, Plasmodium falciparum
TLLKILIGLCIKLGYKRFMIYSE

SEQ ID NO: 3406929 - protein, 20 aa, Plasmodium falciparum
TLNYNPFFFVHNDFKKIWKR

SEQ ID NO: 3406930 - protein, 24 aa, Plasmodium falciparum
TLSFTILSILFLSNLGMYAPCDEN

SEQ ID NO: 3406931 - protein, 29 aa, Plasmodium falciparum
TLSKDEINLFPPYIKKLYYEKYEKYRKEK

SEQ ID NO: 3406932 - protein, 22 aa, Plasmodium falciparum
TLSYIIFLINHILKKGTNKNTC

SEQ ID NO: 3406933 - protein, 24 aa, Plasmodium falciparum
TLVIFFYNTQYDYVEKKKYMTCFP

SEQ ID NO: 3406934 - protein, 27 aa, Plasmodium falciparum
TNEENFLLTFLKRCLMKIFSSPKRKKT

SEQ ID NO: 3406935 - protein, 24 aa, Plasmodium falciparum
TNETVFFIDIKKNRFKGSLGKIPY

SEQ ID NO: 3406936 - protein, 22 aa, Plasmodium falciparum
TNFFNNIKNFFFFSSNDKKEQK

SEQ ID NO: 3406937 - protein, 19 aa, Plasmodium falciparum
TNFILWPDNWTISNTKYHF

SEQ ID NO: 3406938 - protein, 20 aa, Plasmodium falciparum
TNISILAYSPLCAGILTGKY

SEQ ID NO: 3406939 - protein, 24 aa, Plasmodium falciparum
TNKPNCQINWLADCPFGWDRKKED

SEQ ID NO: 3406940 - protein, 33 aa, Plasmodium falciparum
TNMHFYRRKKLKSLLYSDPLKFVKGRKVVEKYN

SEQ ID NO: 3406941 - protein, 17 aa, Plasmodium falciparum
TNNDIYVLKSWFKSMDI

SEQ ID NO: 3406942 - protein, 18 aa, Plasmodium falciparum
TNNHILPFLYDQSPPRKI

SEQ ID NO: 3406943 - protein, 26 aa, Plasmodium falciparum
TNNMDYMVYFLYRNLSYPFIGKSNKK

SEQ ID NO: 3406944 - protein, 31 aa, Plasmodium falciparum
TNNMELRSFLRRVYIVPIIYISESGIIKIES

SEQ ID NO: 3406945 - protein, 26 aa, Plasmodium falciparum
TNVPLKKYLKYNASYAYFTLMNMIGK

SEQ ID NO: 3406946 - protein, 22 aa, Plasmodium falciparum
TNYSVMKLFKKKNIKTPSLLLV

SEQ ID NO: 3406947 - protein, 27 aa, Plasmodium falciparum
TPHFKDVYILIIIYPGESLGMLCNFFN

SEQ ID NO: 3406948 - protein, 19 aa, Plasmodium falciparum
TPLVWDLTQMDWPKAIYPL

SEQ ID NO: 3406949 - protein, 21 aa, Plasmodium falciparum
TQNFSIVNLFSQNPRKVMQKY

SEQ ID NO: 3406950 - protein, 22 aa, Plasmodium falciparum
TRRHSIPMLWIHDNKTVYSIDY

SEQ ID NO: 3406951 - protein, 17 aa, Plasmodium falciparum
TSIHDRDLYTGEQYSYN

SEQ ID NO: 3406952 - protein, 21 aa, Plasmodium falciparum
TSLFIFSLNLTLSYEKSNNRL

SEQ ID NO: 3406953 - protein, 27 aa, Plasmodium falciparum
TSLKFILCCLLLNYILSKVYSFNNLYI

SEQ ID NO: 3406954 - protein, 22 aa, Plasmodium falciparum
TSLNTFYGIVLHGIWSSEYAER

SEQ ID NO: 3406955 - protein, 26 aa, Plasmodium falciparum
TSNDIEYILTLWLFNTFKNKNVDIYY

SEQ ID NO: 3406956 - protein, 18 aa, Plasmodium falciparum
TSYENFRILWMHASSNLG

SEQ ID NO: 3406957 - protein, 21 aa, Plasmodium falciparum
TVKGWLIKPTKKSNKLFLLLH

SEQ ID NO: 3406958 - protein, 26 aa, Plasmodium falciparum
TVKVNLEYLVFLLEKISLITFVEDLC

SEQ ID NO: 3406959 - protein, 19 aa, Plasmodium falciparum
TVNITDWKLRGSCSYDNYI

SEQ ID NO: 3406960 - protein, 23 aa, Plasmodium falciparum
TVQNNILDCILKLHGYKYIHNNN

SEQ ID NO: 3406961 - protein, 17 aa, Plasmodium falciparum
TWYNLKLSYNGSNIKLI

SEQ ID NO: 3406962 - protein, 19 aa, Plasmodium falciparum
TYALPKVKGFRFLKQLFQR

SEQ ID NO: 3406963 - protein, 18 aa, Plasmodium falciparum
TYDLWNEKALKIAVTSLT

SEQ ID NO: 3406964 - protein, 26 aa, Plasmodium falciparum
TYNKEKILYLFKNLFEKTFKDINYQI

SEQ ID NO: 3406965 - protein, 29 aa, Plasmodium falciparum
TYVNEYFLRNYVVIFIYGNIIISDLKGEE

SEQ ID NO: 3406966 - protein, 24 aa, Plasmodium falciparum
VANFLAQFLLFINLSDLTGSFRLY

SEQ ID NO: 3406967 - protein, 24 aa, Plasmodium falciparum
VARNKMFVQFVYSLLNVTLDNDLS

SEQ ID NO: 3406968 - protein, 22 aa, Plasmodium falciparum
VAYAKVPLDYINKLLFSCSCKT

SEQ ID NO: 3406969 - protein, 18 aa, Plasmodium falciparum
VCKFLNCPVVTPSGIKGL

SEQ ID NO: 3406970 - protein, 22 aa, Plasmodium falciparum
VCPINWIDIGKGLCRNIYKNEK

SEQ ID NO: 3406971 - protein, 24 aa, Plasmodium falciparum
VCQPIIVKLYGQPGGPSPQPSGDE

SEQ ID NO: 3406972 - protein, 25 aa, Plasmodium falciparum
VCVSLIFFFLKLSINAKKIFKKNIK

SEQ ID NO: 3406973 - protein, 29 aa, Plasmodium falciparum
VDGEHIRILLLTFLYRFQKEIIENGNVYV

SEQ ID NO: 3406974 - protein, 24 aa, Plasmodium falciparum
VDKSLKIMYSLFNKYTPTNKEMYD

SEQ ID NO: 3406975 - protein, 24 aa, Plasmodium falciparum
VDTLYAYDFINLINISLNRSNKNR

SEQ ID NO: 3406976 - protein, 33 aa, Plasmodium falciparum
VELNVLCSGAPILIQQWKYYQNMLGFEEDKDHA

SEQ ID NO: 3406977 - protein, 26 aa, Plasmodium falciparum
VELSPIFLNAFRRVAIKHLKGGRVTA

SEQ ID NO: 3406978 - protein, 19 aa, Plasmodium falciparum
VEMKRDSIKEIFLKALDDK

SEQ ID NO: 3406979 - protein, 24 aa, Plasmodium falciparum
VFDGYRIYLGFDYKSFQDTHIITY

SEQ ID NO: 3406980 - protein, 21 aa, Plasmodium falciparum
VFELSPFLQLIPRNTPKSYTI

SEQ ID NO: 3406981 - protein, 19 aa, Plasmodium falciparum
VFERTFAYSILMYGGTLNV

SEQ ID NO: 3406982 - protein, 20 aa, Plasmodium falciparum
VFERTFAYSILMYGGTLNVW

SEQ ID NO: 3406983 - protein, 22 aa, Plasmodium falciparum
VFERVLVYMAVILGIKINISSK

SEQ ID NO: 3406984 - protein, 18 aa, Plasmodium falciparum
VFIFLIKLCVCHTEKGVK

SEQ ID NO: 3406985 - protein, 25 aa, Plasmodium falciparum
VFIFSAFLFLLNYATTSQSVNYDNE

SEQ ID NO: 3406986 - protein, 19 aa, Plasmodium falciparum
VFKHCTKIMRIGGKVSSVP

SEQ ID NO: 3406987 - protein, 20 aa, Plasmodium falciparum
VFLFIAVLFCILSPGNNPLH

SEQ ID NO: 3406988 - protein, 28 aa, Plasmodium falciparum
VFNIKSNVLWFYKLVDSVCFILGNTFKD

SEQ ID NO: 3406989 - protein, 18 aa, Plasmodium falciparum
VFNKINKTLYLYINGKKV

SEQ ID NO: 3406990 - protein, 23 aa, Plasmodium falciparum
VFPLLIYFNYVLHRTYGYIIGDV

SEQ ID NO: 3406991 - protein, 19 aa, Plasmodium falciparum
VFVFLYFLNCVGCNSKNNN

SEQ ID NO: 3406992 - protein, 18 aa, Plasmodium falciparum
VFYDFQWGKDFSFEEQKY

SEQ ID NO: 3406993 - protein, 25 aa, Plasmodium falciparum
VGFWPDVMYIIWETISKHIFNDEDA

SEQ ID NO: 3406994 - protein, 19 aa, Plasmodium falciparum
VGGCRTFLYNYILSKQMNG

SEQ ID NO: 3406995 - protein, 24 aa, Plasmodium falciparum
VGNKNDMLFVKNKNLIYPYNDMNR

SEQ ID NO: 3406996 - protein, 24 aa, Plasmodium falciparum
VHDNLSGVYYIFVYLRDPHGGKHR

SEQ ID NO: 3406997 - protein, 20 aa, Plasmodium falciparum
VHEKYNLGFFTPPYEQIIYS

SEQ ID NO: 3406998 - protein, 22 aa, Plasmodium falciparum
VICFVILAYSASLNREKEKKKK

SEQ ID NO: 3406999 - protein, 24 aa, Plasmodium falciparum
VICSFLVFLVFSNVLCFRGNNGHN

SEQ ID NO: 3407000 - protein, 18 aa, Plasmodium falciparum
VIEIFYLSGKIVAFEGYD

SEQ ID NO: 3407001 - protein, 19 aa, Plasmodium falciparum
VIFLVHIWSENVDTFKCNY

SEQ ID NO: 3407002 - protein, 34 aa, Plasmodium falciparum
VIHHYNFDKNFLFPSLNSGIILDITLLKNIYEVS

SEQ ID NO: 3407003 - protein, 18 aa, Plasmodium falciparum
VIHKYAIKLLYGSNYLKK

SEQ ID NO: 3407004 - protein, 18 aa, Plasmodium falciparum
VIIFHVLFRNVADGINVN

SEQ ID NO: 3407005 - protein, 22 aa, Plasmodium falciparum
VIIKDLLILQLTSPIKINTCLQ

SEQ ID NO: 3407006 - protein, 20 aa, Plasmodium falciparum
VILVFIFINKKIKCYNIILN

SEQ ID NO: 3407007 - protein, 21 aa, Plasmodium falciparum
VIMYDYPFKELRRPSNLDLYD

SEQ ID NO: 3407008 - protein, 24 aa, Plasmodium falciparum
VIQILFIIFLKCHCYKIKCFNILD

SEQ ID NO: 3407009 - protein, 22 aa, Plasmodium falciparum
VISFFILLLFCKAYNTSSLLET

SEQ ID NO: 3407010 - protein, 20 aa, Plasmodium falciparum
VISFLLFTKNNEIGSKLIHQ

SEQ ID NO: 3407011 - protein, 36 aa, Plasmodium falciparum
VKNTDEGLSNIYGAKYYLRSGLFNEKNGKGQKYEDL

SEQ ID NO: 3407012 - protein, 19 aa, Plasmodium falciparum
VKPIFTLKSYLYNVGTHII

SEQ ID NO: 3407013 - protein, 20 aa, Plasmodium falciparum
VKQVILFQNYYKDNIINEHS

SEQ ID NO: 3407014 - protein, 24 aa, Plasmodium falciparum
VKRENSFFLRHSPKRLYKKADYNN

SEQ ID NO: 3407015 - protein, 20 aa, Plasmodium falciparum
VKVCLFPFDLICCNGIPVIK

SEQ ID NO: 3407016 - protein, 18 aa, Plasmodium falciparum
VLCSYWLLYHKISVYCLQ

SEQ ID NO: 3407017 - protein, 28 aa, Plasmodium falciparum
VLENDIIIVPPYLIYKYKGKIYHLHNNV

SEQ ID NO: 3407018 - protein, 18 aa, Plasmodium falciparum
VLFPRNKLLNEIKYFYIS

SEQ ID NO: 3407019 - protein, 17 aa, Plasmodium falciparum
VLFQVYIICIKNVKSVH

SEQ ID NO: 3407020 - protein, 32 aa, Plasmodium falciparum
VLIKNVPLDLLVWKLINIIMRGSFNIPIEDKE

SEQ ID NO: 3407021 - protein, 17 aa, Plasmodium falciparum
VLINIIVDLISSDFIKF

SEQ ID NO: 3407022 - protein, 17 aa, Plasmodium falciparum
VLISFFNKSRCDNELSV

SEQ ID NO: 3407023 - protein, 17 aa, Plasmodium falciparum
VLKQIPANISCCPINSI

SEQ ID NO: 3407024 - protein, 21 aa, Plasmodium falciparum
VLLLCTFLINFAKCKYIIFNE

SEQ ID NO: 3407025 - protein, 20 aa, Plasmodium falciparum
VLNKFFVTAAIRNNYYILHM

SEQ ID NO: 3407026 - protein, 26 aa, Plasmodium falciparum
VLSAAVFASVLLLDNNNSAFNNNLCS

SEQ ID NO: 3407027 - protein, 17 aa, Plasmodium falciparum
VMDLYNLQLNTLNMKGK

SEQ ID NO: 3407028 - protein, 18 aa, Plasmodium falciparum
VNEIINILSFFTFNSEHN

SEQ ID NO: 3407029 - protein, 23 aa, Plasmodium falciparum
VNKYKGFFIGYGFNDDIPSVIHH

SEQ ID NO: 3407030 - protein, 28 aa, Plasmodium falciparum
VNNIRGLLLWIYQYLDFKIYEINNIERL

SEQ ID NO: 3407031 - protein, 39 aa, Plasmodium falciparum
VNNPRDSNLYLYEWLQHLNKAFLEKKKALELLNDTKDIK

SEQ ID NO: 3407032 - protein, 30 aa, Plasmodium falciparum
VNNSSFKLLLYKKFQYLQKENIRYLYNILQ

SEQ ID NO: 3407033 - protein, 23 aa, Plasmodium falciparum
VNYHGIYLLIKRTLSLKEAFQSL

SEQ ID NO: 3407034 - protein, 26 aa, Plasmodium falciparum
VNYKHPVFVYIPISAELRGGSWVVVD

SEQ ID NO: 3407035 - protein, 20 aa, Plasmodium falciparum
VPSNVFILSLKELLKTIFIQ

SEQ ID NO: 3407036 - protein, 25 aa, Plasmodium falciparum
VQENPLSGFYWIKPKCSPEPLRVYC

SEQ ID NO: 3407037 - protein, 32 aa, Plasmodium falciparum
VQNHLIKVDINFIQLAHLYIKRYFNEKAELKK

SEQ ID NO: 3407038 - protein, 29 aa, Plasmodium falciparum
VRSDYNFMLSFLRTRKIFSHKKIYFNFKV

SEQ ID NO: 3407039 - protein, 30 aa, Plasmodium falciparum
VSCIYRVIPNKLFLIKLPKLDIVTEKLLPS

SEQ ID NO: 3407040 - protein, 18 aa, Plasmodium falciparum
VSGSYWGIASFSASTGYS

SEQ ID NO: 3407041 - protein, 17 aa, Plasmodium falciparum
VSHVFERVLVYMAVILG

SEQ ID NO: 3407042 - protein, 24 aa, Plasmodium falciparum
VSQTIVSVMINAYDGVIQVVSTIK

SEQ ID NO: 3407043 - protein, 24 aa, Plasmodium falciparum
VSVGCHFILPKWYSTKNNGMIIPK

SEQ ID NO: 3407044 - protein, 25 aa, Plasmodium falciparum
VTFFFVLLHYISCNKPTRNISVKSN

SEQ ID NO: 3407045 - protein, 18 aa, Plasmodium falciparum
VTLIIINLNTIESKYLFG

SEQ ID NO: 3407046 - protein, 20 aa, Plasmodium falciparum
VTQSIPCDPALKTKAQKLIQ

SEQ ID NO: 3407047 - protein, 24 aa, Plasmodium falciparum
VVFDDYFFFIRKSFQNFISISCES

SEQ ID NO: 3407048 - protein, 17 aa, Plasmodium falciparum
VVFLFILNYQTYASSCT

SEQ ID NO: 3407049 - protein, 23 aa, Plasmodium falciparum
VVFQYLLISFSGTSYKRFVVDGA

SEQ ID NO: 3407050 - protein, 27 aa, Plasmodium falciparum
VVKEMYMFIHLFFQDLNLLNKKILDIL

SEQ ID NO: 3407051 - protein, 26 aa, Plasmodium falciparum
VVLCPIIILFFFLNSVVLGNNNRNNI

SEQ ID NO: 3407052 - protein, 20 aa, Plasmodium falciparum
VVLLWRQAWVSSKSHKCDFT

SEQ ID NO: 3407053 - protein, 18 aa, Plasmodium falciparum
VVSLYFFDRKIVCNKKNG

SEQ ID NO: 3407054 - protein, 22 aa, Plasmodium falciparum
VWDTYNYLTPTLKVKRFRVFKD

SEQ ID NO: 3407055 - protein, 17 aa, Plasmodium falciparum
VYERILVYLSFMKGIRI

SEQ ID NO: 3407056 - protein, 23 aa, Plasmodium falciparum
VYLGDFFFFLKRKKYIMYDVNIG

SEQ ID NO: 3407057 - protein, 23 aa, Plasmodium falciparum
VYNLNLYNCDLIDDWDLNHEYID

SEQ ID NO: 3407058 - protein, 23 aa, Plasmodium falciparum
WEHWAYNTLKYFLENDWNIFIQE

SEQ ID NO: 3407059 - protein, 21 aa, Plasmodium falciparum
WFCKGFPTIIPMDGFITSVKL

SEQ ID NO: 3407060 - protein, 24 aa, Plasmodium falciparum
WGNYYRRKLFWYDKNFNKNINKKY

SEQ ID NO: 3407061 - protein, 18 aa, Plasmodium falciparum
WIKDNILYAVPDMNYILG

SEQ ID NO: 3407062 - protein, 29 aa, Plasmodium falciparum
WNYVYQYEMYLYDLFIYYMNKYMKNHFVQ

SEQ ID NO: 3407063 - protein, 20 aa, Plasmodium falciparum
WTLGQVFLKAYYTIFDKDNL

SEQ ID NO: 3407064 - protein, 23 aa, Plasmodium falciparum
WVNHAVPLAMKLIQQLNLNDNAI

SEQ ID NO: 3407065 - protein, 19 aa, Plasmodium falciparum
WYIILNYYVSGQESATNFY

SEQ ID NO: 3407066 - protein, 22 aa, Plasmodium falciparum
YAFVIIFSFNLFVKCGDDISNT

SEQ ID NO: 3407067 - protein, 21 aa, Plasmodium falciparum
YAITIFSIYLINGAIKNESYR

SEQ ID NO: 3407068 - protein, 18 aa, Plasmodium falciparum
YALILKETNFYYENGGQI

SEQ ID NO: 3407069 - protein, 35 aa, Plasmodium falciparum
YAYEKFKYSHELLTYIFFVINLFKHEQFKNKLYKE

SEQ ID NO: 3407070 - protein, 25 aa, Plasmodium falciparum
YCLSRMFRFNFIKNNTPRIKKQCQH

SEQ ID NO: 3407071 - protein, 23 aa, Plasmodium falciparum
YCRPLSIYEGTCLLPYDFSNMTN

SEQ ID NO: 3407072 - protein, 17 aa, Plasmodium falciparum
YDDLCPNLWISINGNEC

SEQ ID NO: 3407073 - protein, 25 aa, Plasmodium falciparum
YDDNVWFVFFYAPWCGHSKPIHPMF

SEQ ID NO: 3407074 - protein, 24 aa, Plasmodium falciparum
YDNKNLIPNLFFFKGKYIEGSNIL

SEQ ID NO: 3407075 - protein, 26 aa, Plasmodium falciparum
YDTKENLIKFLKKNSEYDLYDDDDKE

SEQ ID NO: 3407076 - protein, 19 aa, Plasmodium falciparum
YDYILTYYDKERNYYWEYK

SEQ ID NO: 3407077 - protein, 22 aa, Plasmodium falciparum
YEKREYLFNIWKKIAENFSFSF

SEQ ID NO: 3407078 - protein, 24 aa, Plasmodium falciparum
YESDYIPIIQFFKNEKYNLIDFPL

SEQ ID NO: 3407079 - protein, 17 aa, Plasmodium falciparum
YETLFKQKYINVLVNNI

SEQ ID NO: 3407080 - protein, 18 aa, Plasmodium falciparum
YETYGLDSIFLIEFLNIK

SEQ ID NO: 3407081 - protein, 21 aa, Plasmodium falciparum
YFFFLFLTFFNILKAQDNKNK

SEQ ID NO: 3407082 - protein, 19 aa, Plasmodium falciparum
YFFGYKNYFFSYKRNVNLS

SEQ ID NO: 3407083 - protein, 19 aa, Plasmodium falciparum
YFIYNFLSSYKLDILKEYI

SEQ ID NO: 3407084 - protein, 22 aa, Plasmodium falciparum
YFSHDYLYIPQATSLFPYIYDL

SEQ ID NO: 3407085 - protein, 25 aa, Plasmodium falciparum
YFSSTFLLLLVLQSKTKYIQNFVNI

SEQ ID NO: 3407086 - protein, 21 aa, Plasmodium falciparum
YGFSIFPVYKTFESNPLHFDN

SEQ ID NO: 3407087 - protein, 32 aa, Plasmodium falciparum
YGGKLQKFKRQRAFNILKQWRAKEKKLKEKKK

SEQ ID NO: 3407088 - protein, 23 aa, Plasmodium falciparum
YGGSFDTIFSGFVNLLTPSSPTQ

SEQ ID NO: 3407089 - protein, 34 aa, Plasmodium falciparum
YGSYILYRYTKLYKGFISLDIKLPYEGSFGIIFK

SEQ ID NO: 3407090 - protein, 18 aa, Plasmodium falciparum
YHEGRAYTYFFMHSHDVE

SEQ ID NO: 3407091 - protein, 35 aa, Plasmodium falciparum
YHIIFKIFMYFKTDQFYYHLFLNNIQKIKYYYSIK

SEQ ID NO: 3407092 - protein, 23 aa, Plasmodium falciparum
YHLNLVFYNWFKNSKLKTKEYKM

SEQ ID NO: 3407093 - protein, 19 aa, Plasmodium falciparum
YIDIGCKTLAFLNLGHYNK

SEQ ID NO: 3407094 - protein, 20 aa, Plasmodium falciparum
YIFCFPLINLSERTSKINYH

SEQ ID NO: 3407095 - protein, 20 aa, Plasmodium falciparum
YIFLLFVFILIERCVDNDVI

SEQ ID NO: 3407096 - protein, 25 aa, Plasmodium falciparum
YIFVTLLFFVQVINNVLCAPDNKQE

SEQ ID NO: 3407097 - protein, 17 aa, Plasmodium falciparum
YIPLRRWTNVIITLNNK

SEQ ID NO: 3407098 - protein, 19 aa, Plasmodium falciparum
YIPQATSLFPYIYDLLKNN

SEQ ID NO: 3407099 - protein, 18 aa, Plasmodium falciparum
YIQLRKHGNIPHAGFGIG

SEQ ID NO: 3407100 - protein, 17 aa, Plasmodium falciparum
YIQSFYGVSLDHLNQIK

SEQ ID NO: 3407101 - protein, 25 aa, Plasmodium falciparum
YIRKKTYNKLSYFNLPSLKSIYNNK

SEQ ID NO: 3407102 - protein, 24 aa, Plasmodium falciparum
YIYLFFVFLPFSFCYIRNNDNRFV

SEQ ID NO: 3407103 - protein, 18 aa, Plasmodium falciparum
YIYTLHRLDKLTSGIVFF

SEQ ID NO: 3407104 - protein, 22 aa, Plasmodium falciparum
YKGSFYDFKLKMGDLITSNFES

SEQ ID NO: 3407105 - protein, 25 aa, Plasmodium falciparum
YKNKCKIPLYWIKKLDNLKNMNAIN

SEQ ID NO: 3407106 - protein, 24 aa, Plasmodium falciparum
YKNPYLEHFVLPYIPDKSIYTPHT

SEQ ID NO: 3407107 - protein, 24 aa, Plasmodium falciparum
YKREKLLYVRIINKTLDRNVYEGS

SEQ ID NO: 3407108 - protein, 23 aa, Plasmodium falciparum
YKVYIYVIFFVLVENTMSMKKNL

SEQ ID NO: 3407109 - protein, 25 aa, Plasmodium falciparum
YLARKLQLTWGIYPHLSKKQNLFNH

SEQ ID NO: 3407110 - protein, 23 aa, Plasmodium falciparum
YLFVFILLLKQHIVILKNEEFTN

SEQ ID NO: 3407111 - protein, 20 aa, Plasmodium falciparum
YLGYIYYFIDGYKNLELSLK

SEQ ID NO: 3407112 - protein, 17 aa, Plasmodium falciparum
YLKFCDIDWPCEGEIQN

SEQ ID NO: 3407113 - protein, 25 aa, Plasmodium falciparum
YLLENKLLYDYLYDRNLINDVLYNK

SEQ ID NO: 3407114 - protein, 25 aa, Plasmodium falciparum
YLLNNKLCIPIDDEYIKKIRNEQTD

SEQ ID NO: 3407115 - protein, 34 aa, Plasmodium falciparum
YLPVSHIYERVVFFIALFLGVKINIWSRDIKFLN

SEQ ID NO: 3407116 - protein, 17 aa, Plasmodium falciparum
YLSFLPKNEDVTDTESI

SEQ ID NO: 3407117 - protein, 23 aa, Plasmodium falciparum
YLSLPYKLAPIKCSILSISNNKA

SEQ ID NO: 3407118 - protein, 26 aa, Plasmodium falciparum
YLTINFFILLTLVFQKYSSCQNSLNY

SEQ ID NO: 3407119 - protein, 28 aa, Plasmodium falciparum
YLTPTFKVKRFYVFKDYAFFISQVKEIY

SEQ ID NO: 3407120 - protein, 18 aa, Plasmodium falciparum
YLTYNDFFKKVLCFSNTL

SEQ ID NO: 3407121 - protein, 26 aa, Plasmodium falciparum
YLVIVFLIFFDLFLVNGRDVQNNIVD

SEQ ID NO: 3407122 - protein, 19 aa, Plasmodium falciparum
YMRTMWSELMFKEKLNLFF

SEQ ID NO: 3407123 - protein, 17 aa, Plasmodium falciparum
YNFLLVWKQRKNIDLSV

SEQ ID NO: 3407124 - protein, 21 aa, Plasmodium falciparum
YNFNILCPLNWKNNPDNKTCS

SEQ ID NO: 3407125 - protein, 18 aa, Plasmodium falciparum
YNILKYQCVIKSKGIKIF

SEQ ID NO: 3407126 - protein, 29 aa, Plasmodium falciparum
YNINIPSLLLSKRIIFLSSPIYPHISEQI

SEQ ID NO: 3407127 - protein, 21 aa, Plasmodium falciparum
YNKTLNDFLKIFKMLSQEQRT

SEQ ID NO: 3407128 - protein, 22 aa, Plasmodium falciparum
YNLTENLAIYLYDLSSKYIQDL

SEQ ID NO: 3407129 - protein, 23 aa, Plasmodium falciparum
YNMKIGFGFSLTFQKSINTNIKI

SEQ ID NO: 3407130 - protein, 20 aa, Plasmodium falciparum
YNMYITEFLRYSIGYQRKWI

SEQ ID NO: 3407131 - protein, 19 aa, Plasmodium falciparum
YNNNYSNLGFKYYIKKKKN

SEQ ID NO: 3407132 - protein, 20 aa, Plasmodium falciparum
YNPYLYVLNKSEKDIYIMDI

SEQ ID NO: 3407133 - protein, 36 aa, Plasmodium falciparum
YNSDNLQMDFIYKLQFTKIFNIWDIIDVEILGTPQN

SEQ ID NO: 3407134 - protein, 34 aa, Plasmodium falciparum
YNVPPIHIALLKLLYIMFINNCRIIFIASDEKVE

SEQ ID NO: 3407135 - protein, 31 aa, Plasmodium falciparum
YPRIFTYNIYRTIRPKLLYLILHLNKHFHDT

SEQ ID NO: 3407136 - protein, 21 aa, Plasmodium falciparum
YQINHYPSFRLFPSGNKKPHT

SEQ ID NO: 3407137 - protein, 17 aa, Plasmodium falciparum
YSKICPKGWIKESDGVC

SEQ ID NO: 3407138 - protein, 26 aa, Plasmodium falciparum
YSLERRFEILFWKKYKKKVNMPRLSH

SEQ ID NO: 3407139 - protein, 32 aa, Plasmodium falciparum
YSNYVDVILSLNLLYIPYLLQKIKENNSKIYA

SEQ ID NO: 3407140 - protein, 18 aa, Plasmodium falciparum
YSVILFVNFCVAYGDDSM

SEQ ID NO: 3407141 - protein, 25 aa, Plasmodium falciparum
YSYSCPIGWKETLSFCLAPNSYKFN

SEQ ID NO: 3407142 - protein, 24 aa, Plasmodium falciparum
YTQFSLKSFIKLWCNNRIKFIKTN

SEQ ID NO: 3407143 - protein, 28 aa, Plasmodium falciparum
YVCQSFYDFIYSYFLSYNHHFFDKHKYL

SEQ ID NO: 3407144 - protein, 25 aa, Plasmodium falciparum
YVEAEMLLLALLNDSPDGLAERILK

SEQ ID NO: 3407145 - protein, 25 aa, Plasmodium falciparum
YVFFFYLCSSLLYHRYPFKSKFVYD

SEQ ID NO: 3407146 - protein, 19 aa, Plasmodium falciparum
YVIRRIIRRAIRFGKQVFN

SEQ ID NO: 3407147 - protein, 17 aa, Plasmodium falciparum
YVRKRIYKSIPIFHIGN

SEQ ID NO: 3407148 - protein, 31 aa, Plasmodium falciparum
YVVEVRTFFTYNGLGGLLFIIQSFDKDVEQL

SEQ ID NO: 3407149 - protein, 20 aa, Plasmodium falciparum
YWIVRNSWGPYWGDEGYFKV

SEQ ID NO: 3407150 - protein, 23 aa, Plasmodium falciparum
YYFLFFYVLQVNSKRYAFIKRGI

SEQ ID NO: 3407151 - protein, 17 aa, Plasmodium falciparum
YYITVKDGKYILDDFSS

SEQ ID NO: 3407152 - protein, 28 aa, Plasmodium falciparum
YYKINLYDYFNNIKYFNIYVDNHLYKGI

SEQ ID NO: 3407153 - protein, 17 aa, Plasmodium falciparum
ALFVFLICVFPCITEDT

SEQ ID NO: 3407154 - protein, 18 aa, Plasmodium falciparum
AVFFVLTIFKKLLKWEIF

SEQ ID NO: 3407155 - protein, 18 aa, Plasmodium falciparum
CFICLFFLCILKGVYNVK

SEQ ID NO: 3407156 - protein, 20 aa, Plasmodium falciparum
CIFLVLFTFIDIVKPFKGNY

SEQ ID NO: 3407157 - protein, 17 aa, Plasmodium falciparum
CIILVLCSVQRCLSDEQ

SEQ ID NO: 3407158 - protein, 22 aa, Plasmodium falciparum
CKSEKYKFLYLIYDLRKLYEEL

SEQ ID NO: 3407159 - protein, 19 aa, Plasmodium falciparum
CLILFLLYLNFCACMWPWT

SEQ ID NO: 3407160 - protein, 27 aa, Plasmodium falciparum
DEGLSNIYGAKYYLRSGLFNEKNGKGQ

SEQ ID NO: 3407161 - protein, 18 aa, Plasmodium falciparum
DETLTKMLILLSTDSHEL

SEQ ID NO: 3407162 - protein, 20 aa, Plasmodium falciparum
DYNYLYFYHIYKKMKLIKRE

SEQ ID NO: 3407163 - protein, 17 aa, Plasmodium falciparum
EIMVPLPSPLTDVTTPE

SEQ ID NO: 3407164 - protein, 19 aa, Plasmodium falciparum
ETNNEIMVPLPSPLTDVTT

SEQ ID NO: 3407165 - protein, 17 aa, Plasmodium falciparum
FCIFLFFNVVLSKLDFA

SEQ ID NO: 3407166 - protein, 19 aa, Plasmodium falciparum
FCLLFQYLCIFQNKVSTND

SEQ ID NO: 3407167 - protein, 19 aa, Plasmodium falciparum
FFCLIIVFFSSSFVFSRGN

SEQ ID NO: 3407168 - protein, 17 aa, Plasmodium falciparum
FFCSFLIWVNTMNPGRQ

SEQ ID NO: 3407169 - protein, 19 aa, Plasmodium falciparum
FFFFFCFYFEISFCENDKK

SEQ ID NO: 3407170 - protein, 18 aa, Plasmodium falciparum
FFFLFFVLCVIQENVRRV

SEQ ID NO: 3407171 - protein, 20 aa, Plasmodium falciparum
FFFSFFLLKALNFVSMVYDE

SEQ ID NO: 3407172 - protein, 20 aa, Plasmodium falciparum
FFSFVCLFFRVLSCEGIHEK

SEQ ID NO: 3407173 - protein, 18 aa, Plasmodium falciparum
FFSYAIFYKPYLCKNSKG

SEQ ID NO: 3407174 - protein, 18 aa, Plasmodium falciparum
FFVHPFNLLLLLSIDNEH

SEQ ID NO: 3407175 - protein, 17 aa, Plasmodium falciparum
FIIYIILNCDVLKCEVE

SEQ ID NO: 3407176 - protein, 18 aa, Plasmodium falciparum
FKNFIYGIYGFAKRHSYL

SEQ ID NO: 3407177 - protein, 21 aa, Plasmodium falciparum
FLCIILLLLLIYKCTHSYNIK

SEQ ID NO: 3407178 - protein, 20 aa, Plasmodium falciparum
FLFFFYFSSSIYGNVVAPKS

SEQ ID NO: 3407179 - protein, 18 aa, Plasmodium falciparum
FLIFVFMKINCINYNSFS

SEQ ID NO: 3407180 - protein, 18 aa, Plasmodium falciparum
FLIILVLLKCVLSYNLNN

SEQ ID NO: 3407181 - protein, 21 aa, Plasmodium falciparum
FLKLKVSFYSLLLLLLFIIYI

SEQ ID NO: 3407182 - protein, 19 aa, Plasmodium falciparum
FLLFLFWKKGYSIKKGIKR

SEQ ID NO: 3407183 - protein, 21 aa, Plasmodium falciparum
FLLFLINIYICEANGTLSENI

SEQ ID NO: 3407184 - protein, 23 aa, Plasmodium falciparum
FLPIFFFVLIWYVHYVLGQPSDV

SEQ ID NO: 3407185 - protein, 18 aa, Plasmodium falciparum
FMLIFIRSYTYAIKYKIN

SEQ ID NO: 3407186 - protein, 17 aa, Plasmodium falciparum
FMVATFFIWLWNEGHLW

SEQ ID NO: 3407187 - protein, 23 aa, Plasmodium falciparum
FSFFFFLFPVFCFFQCYGIYKNK

SEQ ID NO: 3407188 - protein, 18 aa, Plasmodium falciparum
FSFFFVYLYYVSCNQSTH

SEQ ID NO: 3407189 - protein, 18 aa, Plasmodium falciparum
FSLFILNLHIYIKNIKCN

SEQ ID NO: 3407190 - protein, 17 aa, Plasmodium falciparum
FVIIGLIYVWDITYSKK

SEQ ID NO: 3407191 - protein, 19 aa, Plasmodium falciparum
FVLFILLKRYKCLSKKKNR

SEQ ID NO: 3407192 - protein, 24 aa, Plasmodium falciparum
FVLYLLFLLKFNKRFIFLKSEKIT

SEQ ID NO: 3407193 - protein, 17 aa, Plasmodium falciparum
FVYIPISAELRGGSWVV

SEQ ID NO: 3407194 - protein, 18 aa, Plasmodium falciparum
FYIAVLFGLIFLNQNVCT

SEQ ID NO: 3407195 - protein, 20 aa, Plasmodium falciparum
FYIFLILNFSFFQSNATSKE

SEQ ID NO: 3407196 - protein, 26 aa, Plasmodium falciparum
FYSLLLLLLFIIYIFFFCSPCYAYNF

SEQ ID NO: 3407197 - protein, 24 aa, Plasmodium falciparum
GFLGIMKIFFKKLFFDFNIFSKNN

SEQ ID NO: 3407198 - protein, 18 aa, Plasmodium falciparum
HFYVFLPIYIKDIYEFNI

SEQ ID NO: 3407199 - protein, 21 aa, Plasmodium falciparum
HIRILLLTFLYRFQKEIIENG

SEQ ID NO: 3407200 - protein, 17 aa, Plasmodium falciparum
HLFCIFLCLGKEVRSEE

SEQ ID NO: 3407201 - protein, 24 aa, Plasmodium falciparum
HLSLCVFLLVCIFYPTAYHKSSSG

SEQ ID NO: 3407202 - protein, 20 aa, Plasmodium falciparum
HYYVVFILLYLYDISCFKCI

SEQ ID NO: 3407203 - protein, 17 aa, Plasmodium falciparum
IAYIYKDILVFKWKVYE

SEQ ID NO: 3407204 - protein, 22 aa, Plasmodium falciparum
ICLCSLILIRTYSALSLKGIKE

SEQ ID NO: 3407205 - protein, 17 aa, Plasmodium falciparum
ICLVTLNLFILEINAKT

SEQ ID NO: 3407206 - protein, 18 aa, Plasmodium falciparum
IFFLFFFHLIKSYNINYH

SEQ ID NO: 3407207 - protein, 17 aa, Plasmodium falciparum
IFLFFIVLEILLLSDRN

SEQ ID NO: 3407208 - protein, 17 aa, Plasmodium falciparum
IFLYYVNAFKNTQKDGV

SEQ ID NO: 3407209 - protein, 20 aa, Plasmodium falciparum
IFVILFHLIGYLKNENKCFC

SEQ ID NO: 3407210 - protein, 20 aa, Plasmodium falciparum
IFWFIPYYCFNYVLCVGNKN

SEQ ID NO: 3407211 - protein, 18 aa, Plasmodium falciparum
ILFLLTYECKTIKKYFYV

SEQ ID NO: 3407212 - protein, 18 aa, Plasmodium falciparum
ILKYYYLLDKYKKPNRKK

SEQ ID NO: 3407213 - protein, 23 aa, Plasmodium falciparum
IQYSTFFLFWNFSTEFWKRFQYI

SEQ ID NO: 3407214 - protein, 18 aa, Plasmodium falciparum
IVFWIYLLERSTSHFRNI

SEQ ID NO: 3407215 - protein, 17 aa, Plasmodium falciparum
IVNFKYSSPLFKKNWSY

SEQ ID NO: 3407216 - protein, 18 aa, Plasmodium falciparum
IVSLFRWYNNFKLIETCF

SEQ ID NO: 3407217 - protein, 19 aa, Plasmodium falciparum
IVYCFISSFYLIKSSSNDK

SEQ ID NO: 3407218 - protein, 17 aa, Plasmodium falciparum
KEFFLFLLNIKKNSQQK

SEQ ID NO: 3407219 - protein, 20 aa, Plasmodium falciparum
KGIPFIYLIKLWASARKHNI

SEQ ID NO: 3407220 - protein, 17 aa, Plasmodium falciparum
KKSSFITYISTKKFKKV

SEQ ID NO: 3407221 - protein, 18 aa, Plasmodium falciparum
KLKDLLLRLLYKAYVSYK

SEQ ID NO: 3407222 - protein, 17 aa, Plasmodium falciparum
KNLFYLIKPKKLIYIGV

SEQ ID NO: 3407223 - protein, 24 aa, Plasmodium falciparum
KNVLLIFFLYIIFFVSKSYSGKTL

SEQ ID NO: 3407224 - protein, 24 aa, Plasmodium falciparum
KPGKYFIVYSYYRPFDPTRDTNTR

SEQ ID NO: 3407225 - protein, 21 aa, Plasmodium falciparum
KQSFKFILYLQHDLITIKWKV

SEQ ID NO: 3407226 - protein, 19 aa, Plasmodium falciparum
KTLFLILYIIILQEYVCHS

SEQ ID NO: 3407227 - protein, 19 aa, Plasmodium falciparum
KTLFLYSYLKDTFAKTIQT

SEQ ID NO: 3407228 - protein, 21 aa, Plasmodium falciparum
KVYDLYDYILNWVFGPMKITE

SEQ ID NO: 3407229 - protein, 22 aa, Plasmodium falciparum
KYYLFKYLMLPLYPRDNQLTDG

SEQ ID NO: 3407230 - protein, 26 aa, Plasmodium falciparum
LCLFFIYLYIYKTYGKVKNTDEGLSN

SEQ ID NO: 3407231 - protein, 22 aa, Plasmodium falciparum
LFIWYFFFVYVKNLSILQYDKA

SEQ ID NO: 3407232 - protein, 20 aa, Plasmodium falciparum
LFLILLNLYKCASISCEIDY

SEQ ID NO: 3407233 - protein, 18 aa, Plasmodium falciparum
LFMLLFYSHVKIKKLFIK

SEQ ID NO: 3407234 - protein, 18 aa, Plasmodium falciparum
LFVFVLYLVSAFIKRQWV

SEQ ID NO: 3407235 - protein, 17 aa, Plasmodium falciparum
LFVLLLQDIIIWKNINV

SEQ ID NO: 3407236 - protein, 18 aa, Plasmodium falciparum
LFYLIKPKKLIYIGVDGV

SEQ ID NO: 3407237 - protein, 17 aa, Plasmodium falciparum
LIFLYFCLYLNIKESII

SEQ ID NO: 3407238 - protein, 19 aa, Plasmodium falciparum
LILYIVFFKNTIKSETTTD

SEQ ID NO: 3407239 - protein, 18 aa, Plasmodium falciparum
LIQFIIYIYFFKTVVKSL

SEQ ID NO: 3407240 - protein, 20 aa, Plasmodium falciparum
LLCFICVIFLLHKNVVRSGD

SEQ ID NO: 3407241 - protein, 18 aa, Plasmodium falciparum
LLFIFLINTLLLSHYENY

SEQ ID NO: 3407242 - protein, 20 aa, Plasmodium falciparum
LLFIIYIYNSLRIKCSSLLG

SEQ ID NO: 3407243 - protein, 18 aa, Plasmodium falciparum
LLFILLYSSDIIISINPS

SEQ ID NO: 3407244 - protein, 17 aa, Plasmodium falciparum
LLFVLFFENLVVSIKYR

SEQ ID NO: 3407245 - protein, 18 aa, Plasmodium falciparum
LLIICSVFFFVYGFNNKF

SEQ ID NO: 3407246 - protein, 19 aa, Plasmodium falciparum
LLIILFPYHVNSRKPIKYK

SEQ ID NO: 3407247 - protein, 18 aa, Plasmodium falciparum
LLLIVSLLKFISAVDSNI

SEQ ID NO: 3407248 - protein, 20 aa, Plasmodium falciparum
LLLVIFLLCLRYGYSIKKKR

SEQ ID NO: 3407249 - protein, 20 aa, Plasmodium falciparum
LLYLNFCACMWPWTKKWKAE

SEQ ID NO: 3407250 - protein, 17 aa, Plasmodium falciparum
LPVKIFLFAFSEYNYIN

SEQ ID NO: 3407251 - protein, 18 aa, Plasmodium falciparum
LPVYFLFFWIHLNIVRSD

SEQ ID NO: 3407252 - protein, 17 aa, Plasmodium falciparum
LYESSILKYYYLLDKYK

SEQ ID NO: 3407253 - protein, 19 aa, Plasmodium falciparum
LYFLLVHLSLCIRYRNQNK

SEQ ID NO: 3407254 - protein, 19 aa, Plasmodium falciparum
NEILTLYFYVLNPGLRNVI

SEQ ID NO: 3407255 - protein, 22 aa, Plasmodium falciparum
NENFIMFLVPHIYIDVDTEDTN

SEQ ID NO: 3407256 - protein, 24 aa, Plasmodium falciparum
NICILFFVVCTLNFSTKCFSNGLL

SEQ ID NO: 3407257 - protein, 20 aa, Plasmodium falciparum
NIIHPLLYFNGIFIFDMMYQ

SEQ ID NO: 3407258 - protein, 29 aa, Plasmodium falciparum
NKARSFFYYRLMRRLLINILSRKYDNALI

SEQ ID NO: 3407259 - protein, 21 aa, Plasmodium falciparum
NKFILFFFFLFTIKTVHIETR

SEQ ID NO: 3407260 - protein, 19 aa, Plasmodium falciparum
NKILLFCLVILILYKYTYS

SEQ ID NO: 3407261 - protein, 21 aa, Plasmodium falciparum
NYHLYYWDDFYHEYKPTYLNY

SEQ ID NO: 3407262 - protein, 23 aa, Plasmodium falciparum
RNQKILLIHLLKNIKELLNRQRQ

SEQ ID NO: 3407263 - protein, 23 aa, Plasmodium falciparum
SDNLQMDFIYKLQFTKIFNIWDI

SEQ ID NO: 3407264 - protein, 17 aa, Plasmodium falciparum
SLYLFFFISYAEIIFCI

SEQ ID NO: 3407265 - protein, 22 aa, Plasmodium falciparum
STMDFIGAFLILESFNLNIINE

SEQ ID NO: 3407266 - protein, 19 aa, Plasmodium falciparum
TFFIYLIFVIGYVTQINGR

SEQ ID NO: 3407267 - protein, 17 aa, Plasmodium falciparum
TFIIFTVLLILILPSYC

SEQ ID NO: 3407268 - protein, 20 aa, Plasmodium falciparum
TLVIFFYNTQYDYVEKKKYM

SEQ ID NO: 3407269 - protein, 23 aa, Plasmodium falciparum
TNPKFSILFLYDKFCYGGIPLAC

SEQ ID NO: 3407270 - protein, 18 aa, Plasmodium falciparum
TSLFIFSLNLTLSYEKSN

SEQ ID NO: 3407271 - protein, 22 aa, Plasmodium falciparum
VCVSLIFFFLKLSINAKKIFKK

SEQ ID NO: 3407272 - protein, 21 aa, Plasmodium falciparum
VFIFSAFLFLLNYATTSQSVN

SEQ ID NO: 3407273 - protein, 21 aa, Plasmodium falciparum
VFPLLIYFNYVLHRTYGYIIG

SEQ ID NO: 3407274 - protein, 17 aa, Plasmodium falciparum
VFVFLYFLNCVGCNSKN

SEQ ID NO: 3407275 - protein, 23 aa, Plasmodium falciparum
VFYNTCHIILLCATIFKLLIYFM

SEQ ID NO: 3407276 - protein, 22 aa, Plasmodium falciparum
VTFFFVLLHYISCNKPTRNISV

SEQ ID NO: 3407277 - protein, 20 aa, Plasmodium falciparum
VTIPLIYKITKLLYFERPFP

SEQ ID NO: 3407278 - protein, 24 aa, Plasmodium falciparum
VVLCPIIILFFFLNSVVLGNNNRN

SEQ ID NO: 3407279 - protein, 17 aa, Plasmodium falciparum
WVLIVFLILYNIKCICE

SEQ ID NO: 3407280 - protein, 26 aa, Plasmodium falciparum
YDINENIFPDYFFLDIFTENKEQKNE

SEQ ID NO: 3407281 - protein, 18 aa, Plasmodium falciparum
YFFFLFLTFFNILKAQDN

SEQ ID NO: 3407282 - protein, 17 aa, Plasmodium falciparum
YFPLIPFINTSFNWLYD

SEQ ID NO: 3407283 - protein, 20 aa, Plasmodium falciparum
YIFVTLLFFVQVINNVLCAP

SEQ ID NO: 3407284 - protein, 20 aa, Plasmodium falciparum
YIRHFIVSLFRWYNNFKLIE

SEQ ID NO: 3407285 - protein, 21 aa, Plasmodium falciparum
YIYLFFVFLPFSFCYIRNNDN

SEQ ID NO: 3407286 - protein, 19 aa, Plasmodium falciparum
YLRGLFPFRPWIDVITKSD

SEQ ID NO: 3407287 - protein, 23 aa, Plasmodium falciparum
YLTINFFILLTLVFQKYSSCQNS

SEQ ID NO: 3407288 - protein, 23 aa, Plasmodium falciparum
YLVIVFLIFFDLFLVNGRDVQNN

SEQ ID NO: 3407289 - protein, 24 aa, Plasmodium falciparum
YNKYYFYLHFFKGKFYWCYYNEEA

SEQ ID NO: 3407290 - protein, 23 aa, Plasmodium falciparum
YPLREWILVTFHYIKGMITLQNI

SEQ ID NO: 3407291 - protein, 19 aa, Plasmodium falciparum
YSHELLTYIFFVINLFKHE

SEQ ID NO: 3407292 - protein, 20 aa, Plasmodium falciparum
YYFLFFYVLQVNSKRYAFIK

SEQ ID NO: 3407293 - protein, 50 aa, Artificial Sequence
  Synthetic
MYGIEYTTVLTFLISIILLNYILKSLTRIMDFIIYRFLFIIVILSPFLRA

SEQ ID NO: 3407294 - protein, 47 aa, Artificial Sequence
  Synthetic
MASLIYRQLLTNSYSVDLHDEIEQIGSEKTQNVTINPSPFAQTRYAP
